United States Patent 9,976,180 (METHODS FOR DETECTING A GENETIC VARIATION IN SUBJECTS WITH PARKINSONISM) - sequence listing, part 39

SEQ ID NO: 488 - DNA, 1068176 bp, Homo sapiens
atttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttaggatgtgaagaggaaggtttgatttgagggagatttaaagtactttagccgagtactataccatctactctgtacttataccatctactctgttaatggtataaggccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatcttttttttttttttttttttttttgagacagaatgttgctctgtcacctaggctggagtgcaatggcgcaatctcagctcactacaggctctgcctcctgggttcatgccattttcctgcctcagcctcccgagtagccgggactacaggcgcccgccaccacgcccggctaattttttgtgtttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggtagcgttcgtcacgcctctgcgtagaatcccccagtgacttcccatgtcactcagagtaaaggccataggcttataaggtgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactgtatgttttacttattttgttttgtgtccctcctcccccaactggaatgtaaattctaggaaggcaaagatttttgcttagttttgtttactactctctctctccaggacctgtggtattgcctggcatagaaggatactcagtgaacatttgttgagtgaatgccattttccatctgagtgagatactgtttttaagagtttgtgtctatttcagcacatgaaggaattgctgtctgcaatttccttgagaaaaatcttatgggaaaatagggacaattttcttttcttttctttccttttttaagacggggttttgctctgtcgtctaggctggaatgcagtggcgttatcctggctcattacaacctctgcctcctaagttgaagcgattcttgtgcctcagcctcctgagtagctgggattacaggcatgcacctccacgcctggctaatttctgtatttttagtagagacggggttttgccatgtgggctatgctggtttcaaactcctgagctcaagtgatcctcccaccttggcctcccaaagtgctaggattacaggtgtgaaccatggctcctggccttcttttctaattttaaacaattgtatccaagtgacattatcctcaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttttgagacggagtatcgttcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaagtgaccttcctgaccttggtgtcccaaagtgctgggattacaggcatgagccactgcacctggcctccatggtgttattcttaagtggtccaaatatgtttttttaaattgtggtgtaatttacaaaaatgaaatacatcttgagtttacagtttgatcagttttaatatatgcacactcatgtaacctacactcctatatagacacagaatatttttataactccataaaatttccttgtgcggttttttttttttgagacggagtctcgccttatcgcctaggctggagtgcagtggcacgatgttggctcaccacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatattgttacagatacccgtagtttgtgcttttttattgctgagtagtatgaatataccatagtttgtttatccatccttcttctgctggtagatatctaggctatttccattttttttttttaagtcatgaataaagcaagctactgccaaaattcactggcaagtctttgtggatatatattttctttttttgggggagggggacagagtcttgctgtgtcatccaggctggagtgcagtggcacgatctcggctcactgcaacctctgactcccaagttcaggcagttctcatgcctcagcctccccagtagctagaattacaggtatgcgccaccatgcctggctaatttttgtatttttagtagagactggattttgccatgttggccagcctggtctcaaactcctggcctcaataatccgcccatgttgacctcccaaagtgctgagattacaggtgtgagccaccatgcccggcccgtggacatacattttcatttcttttttaagagacggggtgtcactttttgcctacgccggactgcagtgatgctatcgtagttggctgtaatctcgaactcataggctcaagccatcctcctacctcagcctccaagtggctaggactaccggtatgctccatcatgcctggctaatttttaaatttttttggcagagacaaggtcttactataatatgttgcccaggctggtctcaaactcctgggctcaagcagtcctcctgcccctatctcccaaagtgctgcgattacaggcatgaattttaatttcttttaatttaatttaatttcttttaaattaaaattcacatctgtaattttaatttcttttaatttaatttcttttaaatgaaaattcacgcctgtaatcacagcactttgaggggtaggggcaggaggactgcttcagcccaggagaccagcctgggcaacatattatatagtaagaccagttgtctaccaaaaaaatttgaaaattagccaggcatgatggcgcataacctgtagtcctagctacttggaggctgaggttggaggatgttaaacactctttcatgtgctcattagctgcttatgtatctttttgtgaagtttctgttcaaatctttatcaacttgtaaattagattttaaaaaatttgtaagctggtgaagttcttacatgttctagacatgagttcttgaccatattttcccttagaatgtggctttaacagtgtctttgatgagcagaattttttattttagttatccaatgtatcagttttttattttattttattttatttttgagatggagtcttgctctgttgcccaggctgtagtgcagtggcatgatctcagctcactgcaagctccacctcccaggttcacaccattctcctgcctcagcctcccgagtagctgggattacaggcacccgccaccacacctggctaattttttgtatttttagtagagaccacgtttcaccatgttggacaggctggtcttgaactcctaacctcaagtgatccaccagccttggcctcccaaagttttgggattacaggcatgagccactgtgcccagccaaggatattctttttataacattttcaaaaattaaggcatattgtatatacaggaaaaaaaatgaagcctatgatttatatttacaattgctttgatttaatacaaattaaaatattactgtttatgagaatgagattctaaatgtaaatggaattcacagaatgcataatttttttctcgtttaaagaaatagagtctcgctgtatgcctaggctggtctcgaactcctgggctccagccatcctcccatttcagcctcccagagtgttgggattacaggcgtgagccaccacgcctggccttgtacatgttatatagtgaccattttgcacaagattgtttgccaaatgaataattaaaaaaatccatttagtgtactttcctttaaatattttcacacctggagttaaaacattgtattttataaaatgttattaatataaaaatacttgtaaataaacttgtggctatgtagaatgtagtagaggacttttgcataagcccagagcctagtttctaaaggtctttagaaatatataatagacatagaggggaaagagttgggggaaatcagagggaggtataattctggtctctcgtcgttcagttctttttcattcagttctctcaggcacgactccagccacttagttttatatttcaactggatgttgacccaattaaaacaattcacagctcctgaagatgaaatactatgagtccctgctttggacacatctgtagtagagtaggaaaagataaatataacccaagtaattgttacagaatcttctgaaatatacaaatggtaaaaggttttgtagggcgtgtactggggaaaaagataatttttcaacatgaaccttttaagagcttgtgagtctcaaagagtctttaattgataggtgatatggataatactcccctttgggaggaggtttataatacataaacaacctccccacccttccctcacagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagtattacaaggttcagtgaattgtctgagatctcacaaatacaacctagataagaacccaggtattattattttcagtcttgcaatattattttcctacttgcaatattatcttcactcttcattaagtttgcacagcaaagtaatggaataagttctgggctttaatccttgagtagtttggaactgtaatgtgttacatttgagagagagcccttcattttgaataaaaccttggtactgttcctgatcttctaacttgggttaatgctcttcccattttcatgatttttttcatttgtgaaatgaagtagttgcactagatcattttcaattttccttcccacttaaatcagttttaattaaaaaaattgcagatgccttttctcagattggagtacactttttgctccacacaatatctggtgtgtaaattggtatgttccgtggagtaaatacctttcctgactagccattaacttacttctgattcctgaatccactaatttaactattgttgaaattactaaaggaaatttttctttagcaaatgtaaaaactcatatcaggtctcaggtttgatgttgtaaagcactctgactcttaggaagactctttttttcccccaacctctcataaacaaattatttcattcattataaaatttcattcattacattttcattcttcagacttgcagtgtttcctctctgctaagtatagtgttaaacactggcaaaagaactctggacacaacatcatgaacttgctctctgggatcttataatctagttgcagaagcagattggtaaatacatagtatagcacaagtactataatggaggcctgaactgagtgctgtgggggtacacagatgaaggcttctgggagacatcatggcataactagacctggaggatgaataaaactttggccaagtaaatacagagatacatgaaaagcatggataaatggcacaagtaggttcagggatgataaaagtgttagtatgtggagagtgtacaactattttggggaatggggaaacagattaaatttggggccagaccccgaaggatgtggggatcccatcaaagtcttttaagcaggagaatgatcagatgcattttttggtatactacctgggggataggaggaagtggactacagaaggggagatcagtagaaggaagacaagttaggaagcttttcagtcattttcattaaacatgaagcttaatacatattgttctaagatcaggaatacagcaataaagaaaaaaacttgctgtaatgaaacttacattttcttgggagagacagaaaataaacatgaaaaacagatgtgttcaatggtgataaagcagaaagggagatggggagtcaagtgcatgtggggagggtgtttagggaagcacttatgaaagagtaacatttgagcaaagagccctgatacaagacaacaatccagacccaagacatttgaggaaagagcatccatataaagggagtgggaggtagagaaaacctggaccaggaatgagcctggtatgattgaggaaaacacaagggatgtggccagagaataataagagaataaattagaggggtaataggcaattgtatagggccttgtgagccattgtgtggaccttggatttcactcttgagtgacctgggagctaatgggggattaaacagaggagggacaggatcctctatggtatatggtaaatgagtagtatggtaaatgaggtaaatgaatagtaaaaggaactgctgtggtaatttaggtaacagatgatgatggtttaggtgaaagtggttggattgtggatatggtttgattggtgttagaaccaataggatttagtggtggctggatgtggacaatgggagaatagaatgaaccaaagctattgtaaacgtctagaaatcagatgaggacttgacgaaaggcattggcaatgagaaagtagacaggcaccattcatgaggtatttcttagcattgatagagttggatataaatatctggaattcttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacgctccacagtcttatcgttcatagtttcttggcaaactcaccactcaagctgtgcctcacttatttaggagatctgcctcactagggtagacattttaggtttatgactcttaagttttcacctggacagattggctaacaaaaagaacctcacaggtgggtgaccttgaattcaccaggtcatgccatcagttcagagcggccggagaactctgttctcttgtgcattgatgcccccggagttgtgaaacacagtggccctgcttcagttttttagatttagaaactggtcagtgtcagagcgatcagacacagaaatgttaattcatgttcaaaaataataaccaggctagcatttgtttagcacttgctatgtgacaagtactgttttaagtgctttacatgaattgtttaatcctcacaacaaccctgggaaataggtcctattattaggcgccctttctacagatgaggaaacagacaacagattggtaaatttcccaagatcacaaagtaagtcagtaggagctcaaagtaacctgactccagagcccacactctttttttttttttttttttttttttttagctggttcacgtctctttaatgagatcaaaggctcctgtgtatgtcttgcgggggtaaagctagcacagtcccccaatactgcccctctcctcagggctccagccctttcaggcagattctaggtaggcagggaggggccaaaaggaacgcaaggagttgggactagggctgtttctggtgggcaagtaacccatccaccctctcaaaactacttatgggatgtccccttcactggaagacagccccatgggaaagacctgcggtacagaatctgggggcagtgcacacggggagtagtcctccagatctggcagggtggcactaaccctcacctccttgactggctcagcctcaccggaggcaggacaagggcagagcttaataccggagtcgccagttaaacggcgatagcggcaggaggggggtgtgggggcaggggtcacccctgccccagactcaccctcctgatgagggagggcactctggtgggaggaaacaccttccacatttgttccttcaaaatgggcagggcagctggatgaggaggaacagcaggtttgttcactggaagcagtcaaggggcggcctggggcgacagtataaggcgcggaggcggggggcggggggtggtgcctgggcggtgaaccacatcctcgtaggctgggggcttgaaggtgctgaggaggcgaaggtcaagcagtgaaccggtagggaaaggaccagccccatggcatgccccatgataagccaacaagttgatttcacgctgccgctgctgttgttgcagcctgagtttagctcgtcggtggcggaaggcccaacagcagctaaagaggatgaggacagtccagagcagccagaaccaccagagctcatagtagtaggtgcagcagccagtctccccgcagcagtgaacactctcacagaggtagggctggttgttcactcctgggcacagctctcgaagctgctgttgcggcgcccgaagtgccccccaggcctcctcgctgccgttcccgctgctggcccgagccatacctccacctacagccccctgaggaccacagcctcctctaccgccagccgccccgcccctgccacctctgctgccactgccatggtccctgcccggcccatcttcgctgaggccaccatcactccgcggccggagcttccatccccagagcccacattcttatctgagcatatacatccccatcacaagagaacgccagtttattcaagtaaaataaggactagaaatttacatcagggaatgtattctttcactgtagaatgctgaatggaaaaccaaatttcaatagttgcctactgaacaagatcatgagataacaacaagggagttgattataaatgactagaagttttaaatggcatcgactctgataaagtgataatctcagctccatgatatactcgtcaagcagttacttacatcaatctgccttataggatatcctttctcctggttaatgcttatgtgatagtgttttgtacctttcctttttcactgctttcattactgaccaaactactcacccccatatttctggtagatatatttcttttcattgcatgttagtatcttaaatttagtcctatcttttacttgatcctccgtgcttgacttcctaatctatgttctggtttatgttttagttttacagttgagctttctgaggacattcttattcccagtatctttttttgggtggttgggttctgggaggtggtatttgactgctgctgatgtgtaccaaccaagacagtagtcattaagtgactaacaataatgatttcagcagattattactcttggcaaagagcaagctttctctattataaatgattttatatttgttttgtttttctttatttgtaatttgagttctagcttaacattattacttcagataactgttaatacattttcataaatcatacattcttgaatggcaaataaataaataatcaagttccaagtagtttctaaagagagtaaacattaaaagtaaacataaaactacataaaaatcgatcacagtctattcataaagttggtatgaaaataaagatcctagatttggaaccctcatgatactcaatattttacatatatcagagtttgtaatttccataacttcatttggtagttagacatatagacagagaagataataatatattcattatatatatatttatgtattatattcattatatatatatttatatataatattcatattatatatatatgtctataacatatagacagagaagataataatatattcattttatagtttaggaaacagacttggaagggcaaataacttgtctaagatgactaagcagctgagtgagaaccacagcctatctgtggcattcagtttcagccatctttcccttgcttcataaggatagttactctggtatcagttgctggattgggattttgggcatttataaatgtttttattttggatattactgaatcacagacaatttcatcttagttaattaaaaattcatcttacgtgacacttgtctaaatcttaaaatattaaaattttaatgtataaggatgttaataatctttatattttaagagactatgaagtcaagtctagctaacttagatctgtaagtttttagctatggaaagcaattctattgtgtacaagtttcagcctgtgaagggaattcattgaaaatgtatagagatcagaagaactaacacctttcttgcatggatttttcttgattattggcagttaacaataaaatgttattagatcactggtgcttctgtgtggggttgagttttttatgatatcttctgttagacccataagggaggctgtgagttgttttctacatccttggaatatataagatcctcttttaaaattatattttatataagcacatgaaaatggaatgaaataatgaattgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatatacgtgtatgtatataaatatgtatacacatatataatatctggagcaaaaatgattatgttgtaagaacttttggaggttttcctcctcgtaaaattccgaagtggtagagttaacattctgcttttaatttatctacaaaaacatgtgaagaatccccaaataagattttctcatagaagattcatggattttgagtctcagaaaaaaaaggaagaaaaaaacttcatggtataaaacaactaaaaattaaatatagtctttagaaatgattttgtttagtataaataatactggtatgacaactgaatgcaattgaaattatgatataaaatttctattctgctttgtatttttcattaaagtttttataattgtcatctgaaaaaggatttaatattcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctaaaattggaaaatgaatattcagatactaagagtaaattttttttttttttttgagacggcatctaactctgtcacccaggctggagtgcagcggtgggatcttggctcactgtaacctctgcctcccgggttcaaattattcccctgcctcagcctcctgagtagctgggactacaggcccacaatgccatgcccggctaatttttgtattttttggtagagacggggtctcaccatgttggccaggctggtctcaaactcccaatctcaagggatctgctggcctcagtctcccaaagtgctggaattacaggcgtgagccactgcacctatatgacatacttgaaaaaatattcttgggccgggtgtggtggctcacgcctgtaatctcagcactgtggaaggtcgagggtggatcacctgaggtcagtagttcaagaccagcctggctaacatggtgaaaccccatctctactaaaaatacaaaaattagctgggtgtggtcgcatgcgcctgtaatcccagctacttggcaggctgaggcaggagaactgcttgaatccaggaggcgaaggctgcagtgagcagattgcaccactgcactccagcctgggagacagagcgagtctctgtctcaaaaaaaaaaaaaaaattctcactttctgttgttgttgtttgtttaatgattaatagacgatttatttaagcaagaatacatagtcatcattgccagacttaatatgacaggttaaatgttggacccaattttccttcccagataagtttttctttcctatccctgtcagttttgaaaacataataccagaagaagaggggcccaattccacacagagctcccaagagtgagtttttaggagtgggtctgaaattaggaaagacacttgctgatcttgcataggtccaaggaatcaaggcaggattttcgatgagccctcggcagttagggtaagcaggtttcagccaggctcttaatggtcaaccacttggcttgcgcctgctgggtttccgaagacatgtcctattcggctggtttgagggcatagtggccaggggtgaaggagtatactttgggaacgacatcttggcgacccagtgcacaactcacttttttttggaaacgaggttggctctgtcgtccagactggagtgcagtggcgcaatctcggcgcactgcaacctccgcctcccgagttcgggcgattgtcctgcctcagcctcccaagtagctgggactacgggcgcacaccaccacgcccggctaaattttgcatttttggtagagacggggttttgccatgttgcccaggctagttttgagctcctgggctcaagcgatctgcccgctttggccttccaaagtgctgggcttacaggcatgacactctgcctggccagatttttgttaccctgtttagatatgatggtaactgaatgatcatgcaatctctgaccatgtgacattcagggataccaaaaatgacttgagatgggccaaggcagaattggagaagcatactttggctgaatacttaggccaaagtataatttggaacatttcttttaaaaaatctactcccctatgcctcccagttgcagtaccttacaattacagttaatctagtagcagatacttgattgggatattaggtatttacagaccaaatgcccattgggatattactcggtaacaggcagtttcactctggttcattgtagattcatccagtaagcatttctagagaactgctatatgaaaatattgtggaaagtatcaactttttaaacttttgatgtcatgacacctagaagattattttctgatactcatattctaagggaattttattttctgagatttgtttctgtggaatttttagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggtaagctaattctgtttggtttattcatgcaatagtctgtctctgcttatgacataaagtataatatattttaggaatagtgtggttttcttcatgatgtcaaacatacaagcttatggatatatttaaaaattcttaattttctagattaatgttcagcactacttcttccatcttgcattggatgggggcagataattaataattatcagatattttcttatcaaaaacaaatttgttggaaaaaaaattttttttttttgagatggagtctcgttctatcacccaggctggaggtgcagtggcgcaatctcggctcactgcaagctccacctcccgggttcacgctgttgtcctgcctcagcctcccacgtagctaggactacaggcgcatgccaccatgcccagctaatttttttgtatttttagtagagacggggtttcactgtgttagccaggatgctctagatctcctgacctcatgatctgcctgccttggcctcccaaagtgcggggattacaggcatgagccaccgcaccaggcctcaataaaatattttataaatacctttaaggaataatacaaacacaaccagagcttaaataaataaatgtaaatcaatctgcttgctggttaagtaatgagttcagtgtttccgcacagaaagtgggagagatagatgaagaagaaaataaagcttattacatgttgggaaggattctaggcactaagttcctttttttgagacagagtctcattctgtcgcccaggccggactgcagtggctccatcttagctcactgcaacctttgcctcccaggttcaagagattctcctgcctcagcctcccaagtagttgggactacaggcacctgccaccatgcctggctaatttttgtatttttagtagagatacgggttcaccattttgaccaggttggtctcgaactcctgacctgaagcgatctgcccaccttggcctccgaagtgctgcgattacaggcgtgagccactgtgcttggccagttctaggcattaagttataattggttcatttggggactcgaaattctccattttattttattttattttattttttctgcttttgtcacaaaagcacagacattgcttaacaaagaggtctgagacaggatatgaatgttaagctcagggacatagggtcaacacttttgagtgcacagactgggaacctggcagagttttaacaatcccctcccctattttcaccatcccttagtcctgtagaagtagagcagatgattacgtattcactgctgtatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgagacaagaataaccagaatgatgataaggagacactggaagtcactttagattgatgaccaaagatttccttattctgaccaggaggtcagatctcaagggtccttctgagtccacttttgattagccaaattgtcttttctttcagtttgactataggttagtcaaccttccctccacattcatcagggactgttagcaatatgtcatatttttttcttggtgtaccattaagcaatctaaagctatgctgttacctgtaaccacttggattaattattttagattagttggttatacttctagggctttatggctttatcttttcagtcagcattattaaccaagttttgatagctttttcaacttttgtaacccccatccagggagatcagtgtcctctcagacacttccaggtaagcatgatctcctggaagacatgagaagtctcttaaattgtctaattattacattggagctacataataactccaatatacctggagttattatgtgtatatgcaagttaggttctaatgaggcaaatataagtaaatatgttgttgattcaggaggtaaaaattaggagagccacgtgtagttttaaaaacaaaagaggaattacttgtaacagaagtaagtaagaaaggaattctcagttatctcttgggtagagataccttgcatagagttcagcaaaaattgcaaaggttgtcataggactatggaggccattaggctaattaaaatttataatattgcccatatatttgtactaagtctcattcctgaaggattttatatttgggttgaggctttgagaaattctaagactggcttgggcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttggagactattgatactcatcagattttaccactgataatttttcaagaggaactgtttatgaaactataaagagaaaatggagatacaaaaagccatccaagatgtaaatgccgaaggccaagttttgagataaacagaaaatcacaaaaactcatgtcaggtggttcttccatggccccagtgtgagcagacagtattttccttgaggagaaatactagtttggtgggggtaaggtagggagttaaactttaaggattaatcaagagaactatacatatgctatttaggttgagggtaaagatcagagtaggcatgggcaacgcctagactcaatcaagttacctatcaagcaagctgacatattcagacaaagcaagactccatctcaaaaaaaaaaaaaaataaataaataaaaagaattccttcattattttgtcatgctttaaggcccaggacaggcctaggcaaaagttttgatggccttttgttacatcccagcctttgtataagggcactggcttttagtatttaacttcattcagtcattactgaaacagttgttatggaagtctgcattagtgagacctggcctgccacaggaggttgcagtgagctgagatcgtgccactgtactccagcctgggcggcagtgtgagactctctcaaaaaagaaaaatgatgcagaaagatttgtttgacacagagtgggcataaactttcaatttgtcaaaaacatagtatctgtgaagtacaataaaatgtagtgcaataaaatgaggtatgcttggatagcaaaacatcatgttgtacctagtaaaggtatacaatttttatttgtgaattatacctcagtaaagctggacaaatgaactgtatttgcaacatggtaggaatatatgacattggacattaatgcaaatggaattttcagtgccatggtgaaaatgttataccactgaacaaaaaaaaagtagtgtgaaatgaagtaaaatgtgaaaatccgtaataaatgcagaaatatgaactgcttatccaaaagagaaaagtcttttgagttcctcaagaagattctctctttggatgctgggcacggtggatgccgggcacctgtatccgagcactttgggaggctgaggaagatggatcactggaggccaggagttcaagaccagcctgtccaacatggtgaaaccccgtctctactaaaaatacaacaattagccgggtgtgatggcacgtacctgtaatcccagctactcgggaggctgaggcacaagaattgcttgaacctgggaggcagaggttgcaatgagccgagattgcgccactggagtccagcctggaccacagagtgaaactccgtctcaaaaaaaaaaaaaaagaaagaaagaaagaaaagaaggttctctctttgggcactccttttcaacatattcagcataaatgaattaatgataccatttttactaggtgagtgtgtttgggcaagttgcttcagtgctcattctcttggtttccttttttttttttttttttttttgagacagggtctttctctgtcacctaagctggagtgcagtggagtgaacatagctcactgcagcctccaacacctagcctcaagagatcctcctgcttcagtctcccaaatagctgggactactggcatgtaccaccatgcctggctagtttttaatttctctttttttgtaagcacagggtgttgctatgttgcccaggatggtcttgaactactgggctcaagtgatcctcccacctcagcctcccaaagttttggattacaggcatgagccatggtacctggctgtcttttgctttccttatctgtaaaaactgaggataataacagtacccttacaaagttggtggaagaatgatattagttaatacaaatgaagtgctaacaaaaagagctttggaacacagcaagtacttgttaggtatggctattgtcatcaacacacttttcaaggcaaacttgtggtttcacctatcacctgagatatatgacttctaagttcatcagatcttctcttttggtttttatttttaaattaattaaatattattattcttattatttgagacagagtctgctctgtcacccaggctggagtgcactggcacgatcccagctcactgcaacctccacctcccacgttcaagcaattctggtgcctcagccatccaaagaagctgggattacaggcgtgcaccaccatacccagttaatttttgcatttttagtagagatagggtttcaccatgttggccaggctggtcttgaactcctggcctcaagcaatccacccatctgggcctcccagtgtgctgggattacaggcgtgagccatcgtgcctggccctcttttcattttagagataggaatctcattctcttccagaggctggagtgcaaaggcatgaacataactcattgcagtctccaactcctgggctaaagggatgttcccccctctgcctttggagtagctgggcctcagaactgtgccacaactactggcttccatcaagatctctgtcctaccatttcatcttcctactaggctatccccacatggatagataaatggtacctcaagtgaaagaaatcaactacctaaaataggattttccactccaaactagattttctttacatgtcatttctgttaatgtgggccacacacactggtaagctcagaatcatctttttcttttcttttattcacatccaatatggttgaaataaaacaaaatgctgtttttccttttttagaaaggcaatacttgttcattatatcaaaatttagaaaatatggaaaaacaaaaaggataaaaaattatccacaaccaaaatagcccaaatttccagttaaaaatatcaacgcatttgatatttgtccacataattaagactgtaatgtttacacaaatgtgagcttttaaaatctaaaaggctctcactattaaaaatgttttgttaaattttgttttaaaagtaagattttaatatccaaattcccaaaatagacatttttgaagatttggaaaatacagacggctgaaaatctttacattattactgttaaattttggtatgttctgttattctgctagtgaaatatatatagatttggggggctattccttttccttttttttttttttgagacaagtgtctcactctggtgcccaggatggaatgcagtggcgctatcacagttcattgtaacctggaactcttgggatcctcccgcctcgacctcccaaagtgctggggctaccggcttgagccactgtgccaggcgaatggctgttcctatatacacagttgacccttgaataacatgggtttgaactgcctgggtccacttataagctgacagaaaatacagtattggaggggcctgcatatagagaggtctgacttttcctctaagtgttccacccgcaggactgactgcgggatttgagaatgcgctttgttttttttttttaggaagtcttactctcgcccaggcttgagtgcagtggcgcgatctcagctcactgcaaccctcgcctctcagtttcaagcgattctcgtgcctcagcctcccgagtagctgggattacaggggcccacctccacgcccgggtaattttttgtatttttagtagagatgggttttcgccatgttggccaggctggtctccaactcatgacctcaggtgatccgcccgcctcggcctcccaaagtgttgggattacaggcgtgagccacggcgcccggcgggcaagacaccctcagagcacagggtgctgccaagagcccggccgagtgcagctcgagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacgtcgcctcggtgcagggctccgccccgtcgcctggaaaggtgagtggatctcgaagagaccgacggcctcgacctggccgggcggcggcctcgacctggccgggcggcggcctcgacctggccgggcggcggcctcgatggctcaggcgtcatggctcccgacgggcgctgctccctggcgcgctctgttgaggcgccggcctcgacctggccgggcggcggcggcggcctcgacctggccgggcggcggcggcggcctcgacctggccgggcggcggcggcggcctcgacgtggcccggcggcggcctcgatggctcaggcgtcatggctcccgacgggcgctgctccctggcgcgctctgttgaggcgccggcctcgacctggccgggcggcggcggcggcctcgacctggccgggcggcggtggcctcgacgtggcccggcggcggcctcgatggctcaggcgtcatggctcctgacgggcgctgctccctggcgcgctctgttgaggcgccggccggctggcgcagtcctgtgggcggcgtggcgcttgcaagcgcaggaagagtcctggggggaccgcggtgggcgggatacctttggcgccggatcttcctctttctcccggtttgttcccgacggtgctcgctcgtgggcccgccctggcccgggctttctggccccatagtacccgcgcggcctagttctcgggggcttgggcacccgggtgctgtatcggcgggtttcttcccatgtcctggacatttactttatatgctgcggcggaggtcgtacctccttggcctggaggaacccagtggggactgacgcagctccgggtgagctttggcggctgtgtcgagtgacaacgtaggcatctcagcacggacatttgcagtggcccgacggcgcaaatgacaggggaagtccccttgttttgagtatgaggtgtttgtcgctgtccctttataagggtccaactccactcatactcacctccctcgccccccccccaccccgcccagaacactttggtagctgcctttgcttaaaaaaaaaaaaattctaaagttcttacaaatcgttagtatggcttacaatttttaaccttttccacaaatgtttttagggtatttttcctctttacaggtaaataatgtgatctattttggattcaataagactttagtaattggatctaaagagtgacggaagaagctattaaaggtggatgtgcacagaatcttgagtcagtttgctttggcttgaataatcacagcactgtcgtttataagctgggtatttggggccagttacacttttcatccatagatggagttgtaacattaatagaatttgataggatgatccattttaaacatttagggtattgcttgacacatagcactaagtgttagctacaagtcactgtttttattgttgatgttaaaaggatattggcggggcgcagtggctcacgcctgtaatcccaccactttgggaggccgaggagggcggattgcctgaggtcaggagttggagaccaacctggctaacatgtcgagacctcgtctctactaaaaatagaaaaaaagttagccgggcgtggtggtgcacacctgtagtcccagctacccgggaggctgaggcaggagagtcgcttgaacccgggaggtggaggttccagtgagccgaggtcgcgctactgcactccagcctgggcgacagagggagactccaaaaaaaaacaaaaaaaaaccaaaaaacggaaactcaacggatgaccatgattataatagtagcataattgtgtctcttatcataactaagcatacgttatcttattttgcgcttccagcaaccctgtggatattgagacctgtagagatttaagatacttgttcagggtgaaataggtagtgcagcagaattttggcagtgggtctgatttagtttctcttgggaacagtggagtaagttacagtctattcctccagagaagaaggatagatatctacttgtacattgtaatttcaaactgctagcatagtataaatatgaatgtgatgatagagtctaaaacagaccttaattgagggttcctgtaactcctgaaattaaagactttaatttttgtgttatttttttttttttaggtggggtctcactctgtcacccagctggatgcagtggcgctatctcgactcactgcaacttccgcctccccagctcaagcgatcctcccacctcagtctcccgagtagttgggaccacaggtgtacccaccacacctgctgttttgttctgttttgtttttatttttggtagagactgggtttcaccatgttgcccaggctgttcttgaactcctgggctcaagtgatttccccgcctccacttcccaaagtgttgggattataggcgtgagccactgcactggccattattttatttttgagacaaggtctctttctgtctcccaggctggagtgctgtggcaggatcgtggctcactgcagcgttgacgtcctgggctcaatccatcctcccaccttagcctcctgggtagctgagactacaggcatgccagctacaggcatgcgccaccatgcccggcttttttctttaatgtagagacggggtcttaccatgttacccaggctggtctccaactcctgggctcaagtgatcctctcgccttggccacaagtgctgagattacaggtgtgagccactctgctcagcctgatttttttttttttaaacaagcttaaaaaaaaaaaaagcatgtttagagcctttctgagattcttagtggggatcttggcttccaaaagattaaaaaccactggtctagacagaagttagaatgttctttcaactacataacgtctccattaaataaagtggagtggtagcaacattttgaggattggttattatgaccacctctcttacacttagagtcttttttttttcccccaaatttaaagtcatttacattagaacctggggatttcagcggaatatggattaactagtgagtaactttggaacatgtgaagctattctgtaaagttaggtttgagtgaaatgacaaaacagggtgctttggatagaaggtaaggaatggagggagaagaggcagtggctgtgaagaatataaagaggttaatattctcccccagtttggcagagactggccatctgtgaactgcccatgctttctagaatgtctgagttttggagtgtgatgatgcgtctgtatatcatatctttctagtcttccattgtgctttcatttgttagtcttctcttgttttgccatttttgtactccctcacatgtgcttttgcccttcttaaaaatattcttcgtctgtaatccaagcactttgggaggcagagagaccagcctgaccaacatggtgaaaatccgtctctattaaaaatacaaaaatgagccgggcgtggtggcagcgcctgtagtcccacctactcggtaggctgagacaggagaattgcttgaaccctggaggcagaggttgtggtgagcagagattgcgccactgcactccagcctgtgtgacagagcgagactctgtctccaaaaaataaaaaaataaaaaaatatataattctttctctagtttttctttttccagatggcttctgtttagtttttctatgttctgtcaagttggtttcttattctgcagctgattcctacttctcaaactctacttgacagctcttatttttatttatttgttttttagaatagggtcttgctgtgttgtccaggctgccatcaaatttttgggcataaatgatcctcctacctctgttgcctgagtacttaggactacaggcaggcacctttgacagctgttagttgttttttctgccctttacatctatacttcatgcttctgagtaacacacacatatacttttgttattttgaattccctttctcccattttagacattttgttttcttttttttttttgagacagagtctcgctctatggcctaggctggagtgcagtgtcgcgatctcggctcactgcaaactctgcctccggggttcacgccattctcctgccccagcctgtagctgggactacgggcacccgccacaacacccggctaattttttagtatttttagtagagacggggtttcaccgtgttagccaggatagtctcgatctcctgacctcatgatccgcccgcctcagcctcccaaagtgccgggattacaggcgtgagccaccgcgcccggccccactttagacattctgtactggctattatgctcctccaaaactgtcctcagacactttgctttgcccctcattgtttcagtactgttattggagtttttgtttaaatgaatatttaacatttatataaatataaggtaaatattttgcatttgaattgcccttgttgtgcagttttgtttttcctggactgaataattgctttattttttggtttgcttgtatgttgtgttactacttggttacttaaactcagcaacttaaaccctcaaatgtggtcaaactggtcacataatccgatcaatttcagcttaaaacattgattgattgattgattgattgattgtctgtctacctggaatacccttactaaccgacttctccaacccagattggtttttcttcctctttgctacacagctgtgctcttgggacttccctttatcaccagtttgagaattcccttcatcttttttctgagttagaccctttgtttcttgtatctcatgtcatcttcatttactttctttgttttggtgtagcatagttcacttgctttgaggaaaagtggatgagaggtttttttgtttgtttttgttttgggacagagtcttgctctgttgcccaggctggagtgcagtggcatggtctcagctcaccacaacctccgcctcccgggttcaagtgattctcctgcctcagcctcccgagtagcgggattacgggtgtgcgccaccatgcccggctaattttttctatttttagtagagatggaatttcaccatactgttcaggctggtctggaaactaatggtatgtctttaaaacatctttacttaatttagttgatcatttggttatcgaattctgagtttgaaataatttttttcgcaattttgaaagcattgctccattttccagaagttctgttgttaggagtctgatgagagtcttgttcttggtaacaaaggttttctggaagtgtcctttcaattgggaaactcatttctttcagttctgtagcgtttcttgtattatttctttgaccatttcttaccctttttttaatgatgtttacctgaaagctggagtttctctaatttttctcttattctcctcttttgtttgttctgccttttgagagatttccttacccttatgttccaggggaagaagattggggaattcatgtttcagtatctagacttttcctcattgtcctgtataatcacggccttcacccttgttgggactccacagatttggagctgatcagatcggtttgttgagaacagcagcttttttggaggattttagggggagggagattcatttgactgtgcaagatgggcgacagagcgagactccgtttgaattaaaaaaaaagagagagaaatttagaactgcataatgaaaaagtaggccacaaatgttaagttttggacaattacaattacatctctatcttactgtgcaagatagcgatgatgtggcatctcttagggtcttactgttcctgttttcagccctgcatcagttcttgatatttggcagcttaagtgaattcaggtatttgcttatagtgacatctgctgtcatgtaaagaagtactgcttgaatcagatattgtcctgtttacataacgtgggctgtgctccttcctagctgtatatctttaaacaaggcatttgcctgcttgagcttcagttcccttgtaaagtgaggttagaggcaaaagatcatacagaagaataatttgtaaagttgtttaattatcttaagattgtctactttaataacatagttggaagcaaagaaggtaatggaattatttttctattatgttttggcattgtaccttgaatctatttcttcattttgaaaagggggaactggccgggctcggtggctgaggcctgtaatcccagcaccttcggaggcggaggaagtcagattacaaggtcgagagaacgacaccatctggccaacatggtgaaaccccatctctactaaaaatacaaaaattagctgggcatggtggcgtgcgcctgtagtcccagcttgtacccgggacgcagaggttgcagtgagctgagatcgagccaccgcactccagcctggcgacagagcaagactccatctcaaaaaaaaaaaggaagcggggaacaagccttgttcctttatgtgctgtcctgactgttgtgtattatttttgttaagattgctatagttcttttttttttgagatggagtcttgctctgtcgccagtgctgggattgcaggtgttagcctggcattgagcaacgttttgtaatttaagcatacaagtctctcacctccttgtttacatttattcccaggcatttttttcatttagatgcgattgtaaatggaattgctttcttaatttccttttctgattgttcgttgctggtacagtagtcccttcttatccacagtattgccttacgtggttttacttacctgcgtcacccgtggtccaaaaatattgaatggaagattatataaataaacatttcatgagttttaaattgcaaacagttctgaataacatgataaaaatctcacagcctcctgctccgtcctacccaggacacgaatcatccctttgtccaatatattcatgctgtatgtgctccccacccgctagttacatactagccatctcagttatcagatcagttgttggagtattgcagtgcttgtgttcaagtaacccttattttatttaaaatggcaccaaagagcaagaatagcgatgctggcagttcacatatgccagagagaagccatatagtgcttcctttaagtgaagaggtgagtttttgacttaggaaagaaaaaagatcgtatactggggttgctaagatctacggtaagaacaaatcttttgtccatgaaattgtgaagaaggaaaaagaaatttgtgctagttttgttgtgacaccccaaactgcaaaagttacagccacagtgtgtgataagtgctttgttgagatggacaagacattaaatttgtgggtggaggacacaaacaggaaacatgtttcgattgatggcaacctggtttgatactgttcatcgttttggacattcactggggtcttggaatttcaaaaataagatgtttgagtggctgtatactctttatcacatggatggaacatactctggttgtatcagcttttttttttttttttttttttttttttgagatggaatcattctgttgcccaggctggagtgcagtggtgcggtcttggcccactgctgcctcccgggttcaggcgattctttgcctcagcctcccaagcagcggggattacaggcgtgtgccaccatgcccagctaatttttgtatttttagtagaaaggaggtttctgcatgttggccaggctggtctcgaactcttggcttcaagtgatccacccgcctcagtctccgaaagtgctgggattacaggtgtgagccaccgcacccagcctggtgtgcatcagcattttggactttggagtttacgtaaccaaggagccaggctgtggaccttgtttattacttgaagaattcaatatttatttctgcctttttgactccttgactgtaaaatactgatctgatctgtagagagaacagtacatgtactattaaggcacagggaatcctcagtgccttaatagatcgtaagtacttacttattctttcccatagaggcttacacatggtaggagaagagatttctggaatacctttcctccccaaagaaagctggtttcttttgtttgttaagtgagagagtggtaccacagggtttccaagatttccaaggctgatgaaaattcttaacttctgttgtctgcttgtcttgctttcttgaatttattttttgtatgttatgtatttattatttagagacaggatctccctgtgtcacccaggctggagtgcagtgtcacagtcataactcacggcagtgtcaacctcctgggctcaagtgattctccttccttggcctcctgagtagctaggaacacaggcatgctccactatgcctggctatttttttccccctggagacaggatcttgttgtgttgcacaggctggtttcaaactcttggcctcaaagctagcctcccaccttggtctctgaaagtgctagaattaaatagaattaaaggtgtgaccaactgcacccagcttatttatgatgacgatgatgatgatgtttgggagatggagtctctgtcgcccaggctggagtgcgatggcacgatctcagctgactgcaacctctggctcactgcaacctccacctcctgggttcaactgattctcgtgccttagcctcccgagtagctgggattacaggcacccgccatcatgcctggctaatttttctatttttgtagagacggagtttcaccatgttataacgccaggctggtctcaaactcctgacctcaggtgatccgcccacttcggcctcccaaagtgctgggattacaggcatgagccgctgcacccagctctattttttgttttgtgataggaaattataaaacatggaattatgcatttgtcaggctttaaaaaaaacttttaagtgaatgaaaatggcatatttgaacataaacttagggcagatttttactacttttgaaaaaatgttggagaatatttctgtatgaaacgtaaaacaacttttaattttttttagaagttgagaggattctattttgcaaagctgtattatgaagctaaagaatatgatcttgctaaaaagtaagtacaaactgtaacatgtattctttttttaaaatcaatgccttttctcattttcttctttgaaataggtaaaaatatgttcttagtagttcttcctaagtgtattctggaataagggatttatcactcagactgatgctaaggaccagcctagattccattgagattgaaaccgtaattagtgttttctgcatgctgctgctttataccaagggcaagaaattgtttggcttaaaacactttttctaaaaattgtcttctgttggagtaaaagaggaccatgcctatatcttcatttgtttttggttagatatctgataccttaatcagatggaaaatagcaatgaataaaaaactgtaattgtaaggcaggagaatagcttgtataaaagatctttaattgacacaatatgtgatgctctaaggctctatcctagggataagaagcttggtgattctgatttcctgactgggagtggattaaagcaggaaattaagagggaggcagggtttttttttttttttttttttttttaggcagtatctgtctctcttgctcaggctggagtgcagcagctggctccatctttgctcactgtaacctctgccttctgggctcaagagatcttcccacctcagcgccccaagtagctggggatacagatgagcaccaccacacctggctaaggtttgcattttttggtagagacaggtgtcactatgttgcccaggctagtcttgaacttctgagcacagcagtctgcctgcctcggcctcccatactgttgggactacaggtgtgtgttactgctcccagctgggaggcaggcttttaaaggcatccaaaggaagatggaaatgctggtaagaaaggaaaatggtggtacataaattatgtaactagcagcactgtgactgttaactcttgtacctttttactgtgagactttaatcccttagtttgggtctggcctaatttctctgatggtaatactgtcaaggaacctagaggatatttacttattttagttgttacttgatttgagaaatggaaatttcctgtatttggtactgtaattagtaatttgtcttctgttcgattttagctggatatagtactgttagaaattactttcttgcttaaagggtaggtgtatttccctttgttgtttgggaaattgttgctgtttagtattttgcattatgataactttaaaaatgtttactataatcacttctaatttatttgcaaaactgttagtgctttattaaaatgtgatcaggaagaaaaagcaatttatatgttcatttcttatgcgtggataacactggagaaaaatttggtaaatgtgacatttaatggtaaaacgagtatgtggtcaactctatgtacgtgtttttaagtattacccatttctttctatgaatacttctgagttatctgcataaatagtggtagttttgagtaacaatataaacgagtttagtggttgctttggtttaagatgtattcttcggttagcatttaaaagtacagttctaagtttaatttacttttgtattacttttgaaaaacagatacgtatgtacttaccttagtgtgcaagagagggatcccagagctcacagatttctgggtcttctttatgaattggaagaaaacacagagaaagccgttgaatgttacagggtaagttataggattcaaatatagcctttgcatagccaaacacatgatgcccagagaaatttatataagtaagtcaaatatattttatgaatatcataaaacaggcattggtatcatagtacaattatgtgacacagcttggaacagatttagaattgtttaacacctataaattgtaagtctaacatggtcagaaatggtgttcttttgtgttcttttgcattcaaatgacacaaatataatttttatttgattcatttccagaaaattccaagacacttttattttaacacctttgaagtaacatgttttctctagaagtagaattttttaagggttggagtgataatttttaacctttatatataagtatataagtatatatactcctacatacatacatacaatttatttactaatctttaatttcttttctgatattagcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggtaaacatacaaaacataaagggagaaaacttaagacataaccatttctaatatttggagtttaaattacttttcaatagcaaaccttaagcccaggtgtttgtgtttcctttaacatttttcttttaaaaagtgtattaaaacctttctgagcatctgctgtcttattaggcattgttatactttataagtgacatctcatttacccttctggaataattaatattttagggattttacagtttagtagctgtaaactaagtagagctaagatttacattaagttctgtctggtatacaatttttgcttcattaagtgaaaattacctacaggatgacaatttagggatattttaaagaagagttttctaataactatggtctgaaagtagaagggattgtattttgagatagtaaagttttcaaggaaaagataaaaggtggtttctctagtatataagatgtaattactaaaaatggtaggaagttcttgctagtgtattgactggtcctgatattctttatagagcaaaatatagtttactaagtaactgttctggagaaaatctacacaaatatgtttggcaaacatttaaaatgtatattgtaatattttatatattaatgtatactttattgtgtatgtacaatataaaattataaatgtatatttgcctttagcctcctcctacccccattgtatatgtttctgatagaaatttaaaaaattttaattttgaaataattatagatttttttgcacaggaagttgcaaagattgcacagaaagatcctatatgctacttcatttttccccaatgcttatacaggttgagcatttaaaatctgaaatcctaaatgctccaaaatctgaaattttttgagcactgacatgatgctcaaagaaatgctcattggaaaattttggatttcagattttcagatttgggatgctctgcctgctaagtatcctgcaaatattccaaagtctgaaaaaattcaaaatctgaaatacttctggtctcaagcattttggataggggatactcaacctgtttaacccgaccaaagcacaatatcaaaatcaggaattttgacattggtacaatgtgtatgtatagttttctttcattttatcatgtgtagattcataccaccactactgtcaagatacagagctactctattaccacagagatcttcctcatgctgccccttttgtagtcatgctatttacttctcttcactatgcctgacctctggcaaccattaatctgttctccatctttatactttggtgatttcaaaatgttatgtaaatgtcatcatgaaatgtgtgacttttttttttcttttttcgttgtttttgagacggagtctcgctctgttgcccaggttggagttcactggcgcaatctcggctcactgccacctgtgcctcccaggttcaagcaattctcctgcctcagccttccgggtagctgggactacaggcacatgttaccgtgtcccgcttatttttgtatttttgcagaaacggggtttcaccatgttggcctggctggtctcgaactcctgacctcatgtgatctgcccaccccagcctcccaaagtgctaggattacaggcgtgagccaccgcgcccagccaagcatgtgaccttttgaggttggcttgttcagtcagcataataccatttgtgatccatattaagttttgtatatccatagttggttcctttacttctgagtagcatttcatggtccacaatttaaccattcactttttttatttttatttttttgagacagagtcttgctctgtcgcccatgctggagtgcagtggtgctatctcggctcactgcaacttctgcctcccgggttctcaggtgatccacccactttggcctcccaaagtgctgggattacaggtgtgagccactgtgcccagccttaaccattcacttttgaggggcattttggttatttctaggttttggctgttgttcaactgctatgaacaatcatgtccagatttttgaagctgaaaaagcattgaagatgcttccaaagataaatattactgataagtttttctccccagtaataagcagctggattttaaatattagtctaaaacatgaggtctaattgtgcagatttctttactctcttaggtgttatgcctcaaacataactcccatattgggcgtggcaatccagttaatctggtgtcagtagtgttaaagaacatatgtaatggcaggagattgttttcttgcagtgtaacaagtaagatactttgaagcactctttaaagattttctttaataacttgaaggcactgttaacacctttcctgtatcagattttttttttttttggaattgaaatccatgagatttataattgtcatgcaaagtaattccatttctcctaaaatttaaggcttgctaaggtaaacagtttctgacatttgtttaatgaatgagagtattactgttgagaaggctttttctctcaagtatgagatagaactttttaaaagcactcatagtggttttttaaaaaatgtttaacatagagtcaaagactagggcttttgcaatagggagagaccagggtatcatccatctcatccagaagaggagaaattgataaaggagagaggggaatgaaatacagagtagtaatggacggcttggtcttgagagctggggaaagacgagtttaagtaggtaaggtaaaatggaatttatatgtgatagcatcaggtttctcagtgaaggatgaatctaggttataagttgaaagtgagggtcaaaggaaggtatggggaagttgaggaaataggaggaggtgtgaagtgtcagggagtggagaaagtgagtctgttagtactaaaatggcattttgttttaggcagcaccagtttgatggttgagataatgcaaatgaaatcagttagcttggggttatgatttcccaaatctaagcacacagaaaccagttgggagggttctgaggaaaagagggaattagttgaagggatctgtaagcaaacagtaattatggatataagggattatagcattttttgcctgacagaagaaagtgtgtgtatatgtgtttacaggtgcttaaaacttgatgatgttattgtcttgaagggaacttgtcatgtggtggagaagtatatttctgaaagtaagggtacgtaggccctcagtgaggtggaagaataagaaggatggtatggtcgtttcggtggtatgaccaaaatgcagattttgaagacctgtgtcagtggcaagtggatggttgaggttggagtagaggataacatgactggagatgaggtgattaaggaactgagtagtcagcctgggcaacacggcaagaccccatctctacagaacgttaaaaaaaaattagccgggcatggtggtgcatgcctatggtcctagcttcttgagaggctgatggaagagcatcgcaaatgagaagcgagtggccacaaaccctacttcctctccttgtatgtaagttcagagagaaaaagccatcatggtagtgggggttatcctgagatgatactgtcttcatttaagatcaggaggtgatgacagtgctttgagatgatgatgaaggtaacagaacagtgggaggagaggggatgtgggattgagtcagatttaaggagatacagagcagtttgagcataaggaccttgttgctgaggattgactggggaggtctaggcttctggtggtgactcagatggacagggatgtgtggcaatagtcctggtagtctctgaagagagtatgagctactgcagtaatcacagatgcttttcttcacatacagttcttgaggcttagtttctgggttgtaagcaactctcagaagggacgaataaggtatataggatggtgtttttggtggcatcatcataaaactagacatagtggaatggtgctttttgggagcatgacttgtttaaaattgcacaagtgttactctaataatttttctttttcccctctaaataggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggtagataaaagctattgggtctttacatttctatgtaggcaattagcatacatctttttgtactaaagcagcagtgccccgcaggacttaaatttcttttatttaggtagaacagttataaaatgaaatttttaccaggatcagttaaatttataatgggaaagttggggagataactatgataaatgtatatatttttggtgttttcatttataaggttgatgtaaaaatcaatgtagtttcacaaacgtggttagagtgagaaaaggaatttgtaggcataaaatggttaatttcttaacacttgattaagttttgtaacttactattcattccacaaaataggaatatctggagtctttacagtgtttggagtctgataaaagtgactggcgagcaaccaatacagacttactgctggcctatgctaatcttatgcttcttacgctttccactagagatgtgcaggaaagtagagaattactggaaaggtgcgttgactttgaggagaatgctttagtataaattgtagtttttctttttgcagtaagttcattgctctaaatttctttactgcatcattatttctataatgtacctaggagttatagttaatacagtgaaccactaggaggcaatcttatttttcttcttttacggggaagttctaattggttttatatgactttcctttttagagaactcttatagttcaagcttgattaaaattagccttatggttaaatactcaggtttgtcatagtcaagcttaaaatgaatgttctaactgctatttcatattttattttttataatagtataatcttgagtgaaaattaaggttcatctgtcatcagatggctaggttcacatgtactagtataagcacttagcatcactggtatttcagaaaatactgttttagctaagaaacaaaataactcaactatgtgatttaccttttttcctaaattttgattttgaaaaccagtgtctccattttgaaaataaattccattgaacaaaaacatcacttggatttgtataaaaatgttagtttagagcaggggttggttagaacttgtgggccaaatatggcccctgcctaattttgttaatatttattggaatgcaacatgcctctgtttatgtattgtctgtggctgcttacatactacaaggttggaattgagtggttgcagcagagattgtatgcctgtaaagccagattagtaatctcctcctttttgtagaaaaagtttactgattgctagtttaggctgtccatttgtttggaagttaatttatttccccatctggtataaggaaagaagttcatttcactgagtgcagggagtaggtaattttcttgaaaaagtacatagtgtcctaaattggtagggtaagagcagtatctaaaagaactaacataactttaagattattttagaaaacatgtaggatgttttattttgtgttctttgtatactcaaattttttggtcacaagttccttttacatttttcttaaggacatcaaagatctttgtatgtgggttcctttttttctttctttctttcttttttgttttgtttttttttttttttttgagatggagtcttgctctgtcaccaggctggagtgcagtggcatgaccttgactcactgtaacctccgcctcccgggttcaggcgattctcctgcctcagcctcctgagtagctgggaccacaggcgcacaccaccacgcccagctaatttttgtatttttagtagagacggggttcaggatggtctcaatctctctttttttttttttgagactgagtcttgctctcgccaggttggcatgcagtggtgcagtctcggctcactgcaacctctgcctcctgggttcaagtgattctcttgtctctgcctcctgaataggtgggactacaggtgcccgacaccacacctggctaattttttttttttttgagacagagtctcgctctgtcacccagcctggagtagagtggcgcaatctcggctcactgcaagcttcacaatttcctctcaatgctctgaataagagcttatcctcctgcctcaggttgttccccaccaggaagccccaggagggccctgaggacagcccttggccctcagagggggaggctcaggaggggagatgaccatggggatggagtcactcaggggagaatccggaccatgagggggtgactgggggcctgaggggaggaccctgaggaagataaaaagctggtgccaccctaggcagtttcacagtgtggcttagggtggtgggtgacagatggtttgtcagatcagttaatcaggactcatgggccctttgttacccccccttgtgaacctcccaggttcacgccattcttctgcctcagcctcctgagtagctgggactacaggcgcccaccaccacgctcggctaatttttttgtatttttagtagagacggagtgtcaccctgttagccaggatggtctcgatctcctgacctcgtgatctgccctcctcggcctcccaaagtgttgggattacaggcgtgagccaccgcgctcagcccacacctggctaatttttgtatttttagtagaaacagggtttcatcatgttggccaggatggtctcgatctttttttttttttgagacggagtctcgctctgttgcccaggctggagtgcagtggtgccatctcggctcactgcaagctctgtctccagggttcatgccattctcctgcctcagcctcccgagtagctgggcctacaggtgcccgccaccacacccagctaattttttgtatttttagtagagatggggtttcactgtgttagccaggatggtcttgatatcctgaccttgtgatccgcctgcctcagcctcccagagtgctgggattacaggcatgagccaccgcgcccggctggtctcgatctcttgacctcttgatctgtctaccttggcctcccaaagtactggaaggtctcaatctcttgacgtcgtgatccgcctgccttggccttccaaagtgctgggattgcaggtctgagccactgcacctggccgtatgtgggttatttctgtcagtgtttattacattagaaattaaaacaaataaaaaatgtaatccattaaaaatgtaataagccctattgtgtgttaataataatagctttttttttttttttttttttttttatttgagacggagtttgctcttgttgcccaggctagagtgcaacagtgtgatctcggatcactgcaacctctgcttcccaggttcaagcgattctcctgcctcagcctcccaagtagctggaattacaggtgcccaccaccacgcctggctaattttttgtatttttagtagagatggggtttcaccatgttggctaggctggtcttgaactcctgacctcaggtgacccacccgcctcagcctcccaaagtgctggaattacatgtgtgagccaccgcgcagggccaataatagcattttttatgaaaaataattattttccaacagcaaaaaagtagtcagaaaagtgtcattgtttttgcatttttgtaaatctttttaatgtctcgcttaatagaacatagctagattctcatttacttcctctttcagtctgtaaaactattacatgtcatgaagcctctagaaaactcagctcagcgggtcgcggtggctcaggcctgtaatcccagcactttgggaggccgaggcgggtggatcacgaagtcaggagatcgagaccatcccagctaacaatggtgaaaccttgtctctactaaaaatacaaaaaattagccgggcatgttggtacgcgcctatattcccagctgctcgggaggctgaggcagaagaatcgcttgaacctgggagtcagaggttgcattaagccaagattgtgccactgcactccagccttgtgacagagtgagattctgtctccaaaaacaaaaacaaaaaaactcagctctacatacatgagaaaatgagtatgtaatatataaatttttttttggtattattgtaaaagtaattttaacttcatggatcccctgaaggggtttttgagcaccctcagagatctttagacctcatttgctctggttgcgttattgtaagccactttaaaatcatgcttcacgtttaagtgtttgctttttgcttttacttttcttccaaagtgaggatttggagaaacattaggatttagaagaactaatttagaatatagattacaaataataggccaggcatagtggctcatgcctgtaatcccagcacattggtaagctgaggcgggcggatcgtgaggtcaggagttcgagaccagcctggccaacatagtaaaaccctgtctctactaaaaatataaaaaaagtttagcggggcatggtggcaggtgcctgtaatcccagctactcaggaggctgagtcaggagaatcacttgaacctgggaggtggaggttgcagtgagcttagattgtgccattacactccagcccaggcgatagtgagagactctgtctcaaaaaaaaaaaaaaaaaaaaaaaaaagacaatttatttaacgctgtaatgatctatatagtaaaaagagcaattgctgtattgatactcaaatacctgtcagttatttacttataatttggaaatggtatgtctaatttgagaaattacaactgttaattaaataatgaaattatatgatcaggaagaaactacaaaatagtctcccaactttatcctggtttattttgaaatgtgcacctataatcactaatcttatatttatcctgtgattggagggctggaaataactgggaataagacatcatttgagaggttaagcatgaagtataggaagtatgcaggataaaaataagcattagatgattcataatttataacatggggaataagaattattagaagttgaatgtggaagatgaagcttgaaataaaatttttattttgttttgaattaaatgaaccatgattattcacagtgcagtaagtgtgtatcatctgtttgatattttcatattacagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggtaagtcttccacttgtaggagcaattgacatttcacggagtcttgatgtgttttaaatgaaggtgtgctctggtatgtaatgacaatatgtgaacaaactgtggaattaaaatgaaatagtcaatttgatacagtggaaaataactaagcatacacaatactggtgaggctggtgaaacagggatgttgagtgcactcttgtcgaaagcctgcattgccatgatttgtttgtagacaaatttgaagagtttgatctttttactctgccatttttgggaacatgataaagatgtaatctcgtattatgggtaaagcttgattcaaaaaggtgtgttacttggacaaaatcctaataagtagatgtagggcaatggctttatagcctatgatagaagaatatgattgcaatttaacatgttaattgaaacacatgtatataacatttatggctgtattgtgtatatgtaacagtatatctattaatctttgaaaacataaaaccttttcttattttttatttttttattttttttgagaccaagtctctctctgttgccaggctggagtgcagtggtgtgatctcggctcactgcagcctccacctcctgggttcaagtgattctcctgcctcagcctcccgagtagctgggactacaggcccgtgctaccaagcccagctaattttttgtatttttaatagagatggggtttcaccatgttggccaggatggtcgcaatctcttgacctcgtgatctacctgccttggtctcccaaagtgctgggattacaggcccgaggcactgtgcctggcgtgcctggcctttttttttttttgagacggagtctcgctctgtcgcccaggctggagtgcagtggcacgatctcggctcactgcaagctccacctcctgagttcacaccattttcctgcctcagcctcccgagtagctggaactacaagcgcccaccaccatgcctggctaatttttttgtatttttagtagagacggggtttcactgtgttagccaggatggtctcaatctcctgacctagtcatccacctgcctcggcctcccaaagtgctgggatttacaagcgtgagccaccattcccggacttttttttttaatgagcttgcataacttttgaaaggaaaagaaataagcagtcttccaaaaaaagcattaaaccaggcttagaaaaatgattaattttagagaaggattttttgcttggggagggaaaaaaaaggattcattacttttagagaaggcccctccttctaatataaatctttttttctttttgagacagagttttgctcttgttgcccaggctggagtgcaatggcgccatctggctcactgcaacctccgcctcccgggttcaagcgattgtcctgcttcagcctcccgagtagctgggattacaggcacacgctaccacgcccatctaattttgtattttcagtagagatgaggtttctccatgttggtcaggctggtcttgagctcctgaactcaggtgatctgcgtgtctcggcctctcaaagtgctgggattacaggcagtgagccagcatgccctgcctaatataaatctttttatttttatttgagacggagtctcgctctgtcaccaggctggagtgcagtggcgcaatctcagctcactgcaacctgtgtctcctgggttcaagtgattctcctgcttcagcctgtcacgtatctgggattacaggcacacaccaccatgcctggctaattttttgtattttttaatagagatggggtttcaccatgttagccaggatggtctcgatcttctgacctcgtgatccacccgactcggcctctcaaagtgctgggattacaggcatgagccattgagcctggcctgtaaatcttttaaaaacaccgttgatagacagttcacatgttaaatgctaatattggctcagtagaaacttctgtgttcataaggaatggattagtgaaaattaatggatttagtgaggttcactaggtaatacaaacattaaaaggttcttatagaaattctcaagtaactgatagttcttatttttatttattttatttttttttgagatggagtctcacactctgtcgcccaggctggagcacagtggcacgacctcggctcactgcaagctccgcctcctgggttcacgccattctcctgcctcagcctcccgagtagctgggactacaggcacccaccaccacgcctggctaatttttttgtattttcagtagagatggggtttcaccgtgttagccaggatggtctcgatctcctgacctcatgatccgcccaccttggcctcccaaagtgctggcattacaggtgtgagccaccgcgccctgccaatagttcttatttttaatggaaactttaaaatttatctgtctgtgtgtctattagagtcttgctgtgtcacccaggctggagtgcagttgcgtaatcgtagctcaccgtaacattgaactgggctcgagcttcccagagtgctgggattataggtgtcagctactgcgcacagcctaaaatttttcgatatgtagttttgggaggcagagtctcactcttgctctggctggagtgcagtggcatgatcatagctcactgcatcctcgaactcctgggctcaagtgatcctctcctgcttcagcctcagctcagtagctgggactacaggtgcctgccaccatgcctggctacattgttaaattttttgtaaagacaaggtcttgctatgtttcccaggctggttggtcttgaactcctggcttcaagtgatccttctgccttgccctcccaaagtgctgagattacaggtatgagccaccacacctgactgtgaacttttaatcataataagttagtttccctcttaatccattcactcaggtctcctttcctagatgacagctactgttaggagtttcttgggtgttcagaaatattttttgcatatgcaaatgtgcaatacattctttctctgcttttaaaaaatattgtgcctcaatgtgggtgtgctttacctattgccagatgccttgcttttctgaatgtttcttcattgttccacttcagcacagagatacctacctcagtctttattagctaccacatatttctgtagaatgaatatataatagaaacatcttagatgcttgtattttatttgatcagtttattttaaagcttaatgaacaaatgattataagcataaaatgtaggttatgtgctggcatttgggtatttaagaattggctaacttttatggcaagattttcagactcttaatcagaggaatactgtggttctagtaagtgcatctgcattgcagctaggtagttaacaaagtatcttgaaaccttttagttaagatgaggaaatagccaggcgtggtggctcacacctataatcttagcactttgggaggctgaggcgggcggatcgcttgaggtcaggagtttgagaccatcctgaccaacatggtcaaaccccatctctactaaaaatacaaaaattagccacgcatggtggcaggtgcctgtagtcccagctacttgagaggccgagacaggagaattgcttgaaaccaggaggcggagattgcagtgagccgagatcgtgccactgcagcactccagcctggcgacggagcgagactccatctcaaaaaaaaaagaggaaatagtgaattgagatgatttgattgagtggattcacaactaattaactggtcacagattcaactgttgaataattttgtaaaagaggccgggtttatgaattgaggtcagtttgaaaacaaaaagaatgatgtcaacattttgtttcttactttgtgtgctcttttcaacatatagatgacaaactttgacatgatgtttagaaaacttgtgagtaaaaggataggcgatatgaatatttctaaaattcaaaatcagaagcttttaggttcataaatcatatattttgaaaaatgagcatgtttggaaagaattatatatacatggtttaaaattctggcggctcttaagaatatgctatgaagactcctttctgttccctagttatttactttctccagccccaaagaaactaatgttattgctttcttgtgtgttcttcaggaaatgttttatgcatctccaagtaaacacacatatatcccctgtctttaaaagaaggaggaaaacatttgaacattgcatttactttatttccattaactgtatcttggagatgtttccatgtcagtatatataaagggcattctcattagtttggatgcttgcatattattccattgtatggatgtactgtagttttggagtttttaaaaccagggtcctaaaaccaggacattagcttgcttttacttttttttttaatgctacttcaagtaatttagcaatgattaacttgtgccatgaattcctgaaagaattgcagtatcaaagtatatctgtgcatttataatttttagagctgttgccaaatatctaaccctaaagaggttgtatcaaattacatttccaccaccaattaagaaagtggtgatagaattaaaagccgatgctctagtcacccatatagttacttttggcatgtttctagtaagtgggcattgcctgtgactggacgttttcagtgatgggcattcattacttttcaagatagcccagtgcatctttaggtggtttggctcttggtacttccttatatagaataaaaatattcttcaagccttctacctgttggtcttgtttcttcttttgatgatttcttttataaaataattttaatacctgaaggcagctgtcacgtcttcccttcgccattctattcatcatgctttttttttttccataggttattgcattaggatctctttaatttcctggttgtcccatttattctagtgctatcccctgttatccatactctgaaaatgtgttatctacaatgtggcatttccaagtgtcatttcacctgtactttttaaagtagggtgtcatatctactcaaataggacaacatctgctgttgtcctatttattcagggcagaaaagtaatataattaaattttccatttctctgaatgtaacacgaatgtgcttttagtagaaactaatttctcagagctgctctgtgtatgctttttttttttttttctttttttggagatagggtctcactctgtcacccaagctggagcacagtggcatgatcatggctcactgcagccttgacctcctggatttaagtgatcctcctgcctcagcctcctgagtagctgggaccacagttgtgtgccaccactcctggctaataaaaaaaactttttttagagatagggtctcaccgtgttgttcaggctggtcttgaactctgggctcaagtgatccccccacctcggcctcccaaagtgctgggattacaggtgtgagccaacatgtctggcccctctttttttttttttttgcgatggagtctcgctctttcacccaggctggagtgcaatggcgcagtctcggcgcgctacgacctctgcctcccaggttcaagctatccttgtgcctcagcctcccgtgtagccggaattaacaggtgtgtgccaccacgcctgcctctttgtttttttttttattatttttagtagagactgggtttcaccatgttggccaggctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagacaagaccatgttactattagaagtatgggtatcatcaaattaagatttttgattctaaaattattaggttccaagaccaaagattaaattaataaaaggtgaagctggacaaaatctgctggaaatgatggcctgtgaccgactgagccaatcaggtaatagtaatattaaactaatttaatttaaaaagaaaaaggaatttctgttaaggcatatcttatgataaaatcttcatctgtccaggagataatttgtcaaaattatttctttttgccgtatcagttaagagcaataggtatggaagagatgcgaagaaatagcacattctttaaaaaaaatgaatatttgatattgtttgttcctatgtggagaggatttcttaactctttcttcatctggctgctagagcctctagcctgaatatttagtcacttcctgaactaagtataattattgatttgccaaccatttaacaccagctgattctaaaaacactgctgtggggatataaagatgaagaagatacggatctgtcttaaagagctgagagcatagtgaggaagatagaagatatatacttaccttatattaggctcttggaatttgtggatttttttcccccgtttttggcttgggatgaatcctaaaggtctgttgcatattacctgtgattttgctaagatacaaactttaaggtagttagatggccattgaatcaagcagtgaactgaagaaacataatgcttcctataaggagcagttttgatataaaattggatgaattttgtaaagagcaagatgtaatattaaatcaaagttattataagctttggtgtatagttaggctgttggccaaagctcacattgctcttttattccatagcccactttttttgtgggagctaggctttcagtccttaaagtgactttctacttttttccttttctcttttccttctacccttgcagggctctcataagtgcctttgcatggtgtcacagttagatgaaaattgcctgtattttttttttatgtctttgatctgggcatcccgagggtgcctctgtaagtgtgctgagacacaactgtgtagtggtaaccaaacctaattgcccagcagaattaactcaaaggagggtttttaaaaaaagttgaattgaaatataattcatgtaccatacgcttcacccatttaaagtgtacagttcagtggcttttactatgttcatagagtattaccactgtcaccacagtcagttttagaagattttcatcactccatgaggaatttcttacctattagcagttactccccattttacccaaacctctcagccttggcaaccgctaatctgtctctgtaggtttgcctcttctttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatctgcccgccttggcctcccaaagtgctgggattacaggcgtgagccaccgcgcccggccggtttgcctcttctgaacatttcacataaatggaatcatgtagtatgtggtcttttgtgactggcttctttcatttagcaaggttttcaaggttcatctgtgttatagcatgtatcagtattttatccgaggactatgattttttgattgcttactgtaaacctatggaataaaaatctctgggaacaaggcctggaaataattctttttttttttttcctgagacagtcttactctgtcgcccaggctggagtgcagtggcgtgatctcggctcactgcaagctccgcctcccgggttcacgccattctcctccctcagcctccccagtagctgggactacaggcgcccgccaccagggccggctaattttttttttttttttttttgtatttttagtagagacggagtttcactgtgttagccaggatggtcttgatctcctgacctcattatccacccagcttggcctcccaaagtgctgggattacaggcatgagccaccgtgcccagccggaaataattcttaaaagctgtttaaaggaggattctgatcagccaggttcagaaatcagtgtatcagatcagagaataagagcttgtccctgttctcctatggccacttaaatccagaccttttcatctaaaatgcaaatatgtttggcatttttcatacacattcctgtcttttttcccccttctgctgtcttatgtagatactgagaatattaaacctgtactcttttcatttgctacataagcacccgttttgttgtccagctgtattttttgggttggagggttaggtctgcaataatcatgttatttcccctttgggtatacaaatgagacaacgtgagcaaatacaatctgtatttttaaagtgatggaaataacttaaatttttttttcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtaagttatatgtttcagaggaaatggtctccgtcttaattattataaattgcccataatcttattacccagaaataacgacttaatattttcctgtattccttttgtgtgtgggttgggctggggggagtttgaatgtggtgctgtaggggtggcatgtattttttgttgttgttgttgtttttgagaccaagttttgctcttgtcgcccatgctggagtgcagtggtgcgatctcggctcactgtaacctctgcctcccgggttcaagtaattctactgcctcagtctcccaagtagcgggattacaaatgcccaccaccacgcccggctaattttttgtatttttagtagagacggggtttcatcatgttggtcaggctggtctcaaactcctgacctcaggtgatccacctgccttggcctcccaaagtgctgggattacaggagtgagccaccgcgaccagccttgttgtattttgagacagggtctcgctgtgtcacctgggctggagtgtagtggcgtgatcgtaggtcactgctgccttgaacttctgggctcaagggattctcttgcctcagcctcctgagtagctggtaccataggcacatgccactcggcccagataattttttttttaattggtagagacagggtctccctttgttgcccaggctagtctccaactcctaggctcaagtgatcctcctgcctaagccccgcaaagtgttgggattaggcctggcacagtggctcatatctgtaatcccagcactttgggaggccgaggcgggcagatcacctgagatcaggagttcgagaccatcctggccaacatggtgaaaccccatctctactaaaaatacaaaaattatccgggggtggtggcatgtgcctgtagtccctactcaggaggctgaggcaggagaatcgctccaacccgggaggtggaggttgcagtgagccaagatcacactgctgcactacagcctgggcgacagagcgagacttcgtctcaaaaacaaaagtgttggaattataggcatgagccactgcatctgaccatatttttcatctaaatggttgtttatgtatgatttatcttgcttccttcatgaattctctcccatagtctctgtattaaaactataaatatcacttttattggcaatataatcttttttatgaagtagtcataatttgcttgcaactttctgttattgggcatccaagttttctcaacttttccactgttaataatcatactctgataaaaacttcaacaaaaagtgtcttcattgcaagttatttccatagagatacctaaaaacagaattactgagacaaaggacatgaacatctttaagtcttgcaaattgccaaaatgacagaaagattatacctcttcatgcttccagaagcgcataaccttttcttttcttttcttttcttttttttgagacagagtctcgctccgtcacccaggctggagcgcagtggtgcaatctcggctcactgcaacttccgcctgccaggttcaagcaattgtcttgcctcagcctcccaagtagctgggactataggcatgtgacaccatgctcggctaattttttgtatttttagtagagacggagtttcaccatgctggccaggctggtctcgaactcctgactgcacataaccttttcaatattgactttcttgtagaaaaacagatttctttactgtaccgatggattaatatagtggtgttccattgctttaatgacttaaaggaaaacccattgttttggggtttcttattaggttaggtgttctttatttggcttttgtcagttgattttggtttattgagttctagtcagtgtcattttttaagatggacttaaacattcttcatcactactatttttattaaaatttctagaaataatcaagtgagaatgcatttaataagaacatgagattttgcctaacatagaattccctccagctttgatatagaaaagcagttatataattaagatatatataatgtgaattgtttatgttggcaaaactaatggcacaaagaaaaatttcaaacccttaagccaatttttttattttatttcaggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtaagcaaagattttaacaaattaaatattctgaattttgtttaatttttttttctaacttaacttttccttaaataaaacaggtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagcgctgaactgtgtatttagaaaacaattttagtaaattgaagtattttttagacctggaaactcagcagaattgagacttgtagttcagcatgaaataaacactctaagagcccaggaaaaacatggccttcaacctgctctgcttgtacattgggcaaaatgccttcagaaaatggtgagttttaaagtataagcatttttaaagaacattaccttaattttttaaaatcatgcactttttattgaaagtttttttgttcagaaaacagcagcttggtcatattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctaaatatttaaggtttgttttgtgtcaccattaggtgaagatggtcagccttttgaacaaactgacactacagaagaggcaggtttcagctatctaaaaatggcaactgttaaaaagtagttgggattgctacattagggtggtatcattagaagtgtttaaaagttgagtgtagaggccgggtgcggtggctcacatctgtaatcccagcacgttaggaggccgaggcgggcagatcacaagatcaggagatcgagatcattcctggctaacacggtgaaaccccgtctctactaaaaatacaaaaaaaaactctactaaaactacaaaattagccagacatggtggcaggtgcctgtaatcccagctacttgggaagctgaggcaggagaattgcttgaacctgcacggcagaggttgcagtgagttcactggtattaaggtggtttagttattacagtatttggaagttgaacaaatgactattgaggtaccatttggttttgacttgaaattttagccagttcttacaacctgtaaatgaactttagatctaatcatgcgtgttccttaaagttgtgtgcttttaactttcttttttagggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggtaacagagttcctttatgaatttattggagatgggaatttccagtttataaacaaagacgtggagctataaactgcttaaattaattgccttgttatttaacggtaatcttgttttctaaattcactagctctcacagataagatatgacagagaagagtaatgagatgtttgtctcttaagatcatataaaatctttggaaaatcatttgggttttatattctgagtataaacaatttgactaaaaactattctgtgtgtttaggcatcagaaattgttgagtatgaagaagatgcacacataacttttgctatattggatgcagtacatggaaatatagaagatgctgtgactgcttttgaatctataaaaagtgttgtttcttattggaatcttgcactggtaagtagatgcagtacttgagctaaaagttttatttatttatttattatttcttttaaaagacggggtttctctgttggccaggctagagtgcagtggcacaatcttggctcactgcaacctctgcttcccaggctcaagcgattcttgtgcctcagctcccgagtagctgggattacaggcatgagccaccatgcgtggccaagctgaaagttttttgttttaaaaagctaatgatttcataaaagcactatttgtatagatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaagtaagtagcaggttgttgtatgtacgttcttactgataacccactggtcagtgtttttgcgttggtcttatattttggtaatttcaaaaatactcagtaatatgttgttattaatgcacagaagggatgtgtgtgtctaaatgcttatatttgcttgctttgtcttaggtttggtgtgtctttttaaacttgggaatctaggtgttatcttagcagtgtaatcaaaacaaatattataacctcaggactaattcttaatgaactttgctgaaattgaaagttgttgctgacaacttaagagcatttcttctcatcctcatcagccattatgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagattgtacaacacttttctgtgttcatgaagaaaaaaatagaataaagacaaaaaaataaaaataataatacaaaacagcagaaaaacaaagaaaaaagataattaaaaaacactttcacgtgtattattatttaaagtgtaaagtgcttattaaaatgacaaaaatgtaaataagataaaatatatcattttagagtttttacttttggaattttttgcaaatgaaagcccttaattaatgtcttttatttttagttgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaaggtaaacaggaaagaatggaatcatttcattgtgaaattgtttctaagtgttttaaatgctcttttgttatttttatttttttttttagtattctcccaaaacaccacctcgatgggcagaagatcagaattctttacggaaaatgatttgccaagaagtaaaggccattacggtaagtcacttaatttctctagctgtactttttattccaagattccttccctggccactctctcactttttttctgaagctggtcagaatgtccccttgccatccaaatagtatggcaaggggacattttggtctttttttttttttttttttaaggcagggtcttgttgtgcaggctgcagtacagtggtatgatcacagcttactgtggcttcgacctcctagctcaagagagcctcttggcttagcctgccacgaagccaggactacagagagtcacacgccactaggcccagctaattgtattttttgtagagatgggatttttccatgttgcccagggtggccttgaactcctggctcaaacaatcctcctgcttcagcctcccaaagtgctgggattgcaggtgtgagccactgtgcccagcctacataccttggtcttgaccctttaccatattttgttttgttttgttttgagatggagtctcactctgttgcccagtctggagtgcaatggtgcgatcttggctcactgcaacctccacctcccaggttcaagcgactctcctgcctcagcctcctgagtagctgggattacaggcacccgccaccaggaccagctaatttttgtatttttagtagacacagagtttcaccatgttggccaggctggttttgaacttctgacctcaggcgatctgcccaccttggcctcccaaagtgctgggattacaggtgtaaaccaccacacccagccctttactatatttttgaaagtactttatgtgtctctctcctcatcttccacaaaatttgagaccttcaaaggtagaaactgttttatttaaaatataagagttcctgacacagagaaggttcccgagtgattgaactgctacagtgtactaatcatactctggtctatgagttcattctcagattagctgtggattacatgtgtttcaaatgtatagctaggaattgaaaagtggtctgagcttcaaaaagtcttgctatattttaatacttccatatgaatttgacttaattatgtaaggaaatagttatgtatatatatcttattttaacaatagggttcaaaggagcttgacttttttggaattggaaataaaagtaggttctttcatgtttatcaggcaagaactaaattatactgctaaagttacatcaaggatatgctgatgtgtggcgattattacagtgtgatcagcagtatttgcaaattgagagaatactatttggtggggaagacatttttgaatttgcacaaaaatcttgaatgttaattctgtgtagtcatggcctatgacaattacatacaattttgacttaacatacaggtttcaggctcccaacattgtattctgtggaagtatagtggagcactagtccatgagcttgaaaagcttggtactagtactgactctgccattaattaatgatcttgggccagtcacttccttcgtgactggcttcttatctttaaaatgagagaattattgaagccagttctcattacactgaatgttaaaaattacagttacagcagtgattgcaaattcaaagctctggtgcggataccaacagtgaccataaagttttctaggtgattccactagtttcttatttcttggatgtgtatgtgtagcatctggactaggcactgtagatggatgagtgggggaaattttatttagcttgaaaattgagatagttttggacctcatggttaggtctttctgggaaatttttatttgaaacacttgtagaaaaagaaagcagacatgctagatctgtccctgacctcacttgttagaactggtcggattcctgggctgatacagagaagtttgaaacttttcaaaatttacctgttttctgataccactacaatttctttggaaaaagaatttcctgttaagtgtctgttttgtaaggggacattttgtaggttctagggttgggtatggtgctgtcatttagttttcttcagcagagatcaggtagccacatagctacactagatggcattgtatctatctgccatcttgtcaaggcagcagagttgtgttaagagaacatttttggagtcagatgtggttcaaattccagctgttattccctgcatccctttctctcattttaagataggagctaatattgtttacctaacagtgtagatagtataaaaattaagagtttaagtgcattggacgtattattatatacataataaattatctgcagctactgcttttttccctttcctggtggagcatttgaacgtcacctggagaattagttgtattttgtttcagcatggggttaagtgaaaagctaatttggggaggtgatttggaatgtcaggtagtccagattgcagtatagaaagaacacactgaaaggatggtcagtgtaatgttagaggactgtgaaagttggggaaagaagtttagtttgtaggtacttgtttttttgagcagggaattgtcttggctggaggtgaatgtcagaaaggttaatgtaggcaagtgtagaatggaaatgaaggtgtgatcatttaggaggttatttgtttaggtgagagagttaatgaattaggttttgtattaacgaatgaaaatgggagcagataaatttttaacaaattaagaatcatattttaaaatcagcaccaggtacctagaactcattggcaaatagaaactttcaaaagatataatcaggtccgggcgtggtgggtcacacctataatcccagcactttgggaggctgaggtgttggatcacttgaggtcaggagttcaagactagcctggcaaacatggtgaaaccccatctctactattatacaaaaaattagccgggtgtgctggctgacgcctgtaatcccagctactcgggaggctgaggtgggagaattgcttgagcccaggaggtggaggttgcggtgagccaagattgtgccattgcactccagcctggatgacagatcgagacaccatctcaaaaaagaaaaaaagaaaaaatcagttatttaaatttaaaagagtaagtttccccagcactgtttctggcatgatataattaaatgattaaaattatttgatttttttttcttccaatagaaactaaatagcagtaagtcagcatcccgtcatcgttggcccacagagaattatggaccagactcggtgcctgatggatatcaggggtcacagacatttcatggggctccactaacaggtgagctggcaagtgcataatcgcatattttagtaaaactactttacttccctcttttaagtagataacgtgtgaaatcaccttgtttatatatgtttgttaatatacatgtcaacgtctgtttatatgtgacttcaaaagctgtatttggtgttacggagatttttataatcccaagcagaaaaaacgagccgtatgtgatcacgtgtatataaaggcttaaagaacacttaatccacacctcagatgagctgagatgagattattccttaaattgaaaaatgttattgaatagagttatgcactaagaaatgcttaattaagaacctacacctctggggaattattttgatgataatgatgagaggcaggacgttatataggaaatcttacttaatttgaaatattatggttatataaagaaagaaaaggagtttggacctgaatcatacagggtttttaagttctgctctatcacttactataatagctgtgtaagttaacctgtctgaaatgtggagataatacttgccttacataattactatgagcatttgtgtatgtgcaggtgggcgtgggtgtgtatcagacatttattagagtatacagtaaacagttaatgaactaaggttactaatagtgtttactgtgggttggctatgtgcaaaagtgctttgtgaatgtaatttgatttaattacagtaacttagaatggccggtaccattattaatcccttttttataaataaggaaatggataaagaaaggttaggtaacttactcattattatacagctagttattgatagagccgagattcacactccagtggtgtaactccaaagcacttgccagtataatacattgctcccaggcagccagaaataaaaaaattgttccttttacgtacgacagacttctgaaatggtagtagtagtgcccttttttttttctctttttagcccaggaaagatttagaataaaatctagtttagatgagcacatttgtgtgatggttcctatagttaaggcaaccccactagccttttgtgatagtatcttctcaacacaagcaaaataacagaaaatctttgtgaagtcaagcttattaaatgtcgtaagtcatagataagtatatgaaatgtctaacgttcaaaccttgttttcttaaaaccttacacatcatataggtccttgtaagaggataaacaaaccggctagcctttcctggggcttttttagtgacgtgtgcagtcagttatttggtgccttgtgggtcatgatttccatttcttctgtgtacaggcataaaaggtcttctgttcttatacaagcatgtaaatccaacattctcattgtctcattttattcttgcaatgaccctgtgaaatgtgtagaagcagcatatcctcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaagatggtccttgtttttttaaaataagatgattaaaattaaagattaatgagctcataggagatactcagaagtactgaacagggtgaagaaaactaaaaactaaccaccttattaacatttcttatatttgagagcatttccttctggttctttctctatacatatagtattttttatgagattgttaccatgttactatgttgtgtgtagatgagctagcctgttttttaaatgttactttagttctgagcatttttaaacttaaatgttttttgaatattaatgagttcatggtgtcccatcacatggaagtactgtaaattctgttcctttatttatgttgtttctggtttatgccattacaaattctaggacactgtcctagttttgtagggtattcaaaatattcagtttatgctcttaccactagtatctgatagtgccattttcgcacttttgctaatgctgacttactagtttataaaatcctttgccaatttgtaggaacaaaagttatatcaatttttaagtttttttaatactagtcatgctcaacaattcatgcaaatggcagttggtagttttgccatcttcaacgtgggtaccttccagttgtttggtttcttggtaaaactcacacaaaacagatggagaagagtttttgtatatcaacatgaatgttaatgtgatttttttaaagccaacgaacacatttgtgttccttgtgagatcctgtgcatgaatttgtcaggtaatttttttgacttgaacattctcataatagcttcaatttgcacaatgcaaccttgtcattttgcagattttcaaggctcacttcaaaaacatgttccttgaggcctattaacatttctttcctaaattgtctattcatatggtgctttaaaaaattagattacttttagtatatttattagagcctcacagtttagagtcagtagtcaattaaagtccctacttaaacttcagactaagattttttttttatttaatattttattttttctttttgctttcatgcagacagacattttgcaagactttaagattcttgggccatttctgtcaggttgttctgtgttctgtgcctgcttcctccccatagtaatttcaaaatagttatcctcacctctgtaaggtttccaaaatcaaacttgggcttctggctagccttttctaggtcttgatttttcagtgctttccagaggcaattgtttggaacctcttcgcacagtttctgtttcttcttccatgtacaggcataaaaggtcttttggttgttttctggtaaaactatcataaaacagttcaagcaaatgactattggtagttttgtcattaacatgggtgccttctagtcgttttgtttcctggtaaaacagaccaaacagagggagcagacagtttgtacatctgtatgagtgttgatgtgctttttattttaagccagggaacacattttatgttatttatgacatcctttccatgaatttgtcaggtgatttttgagctgaacattctcagtaatagctttagtttacaaaatacaacctagtctttctgcagattttctaggcccacttcaaatgcattgaccatcagatggcatcttggttccttacgtcctttctgtgactgaatgtccataattccacatcatactgatctttcttagaaaaggcaacagttactttctcctttattccttttttaatgcttgtgaggtagttcttgttgatcacagcgatgctattctcttattcttcatgtcatatttagcaatttttttctagtttgtcatttgataatcttgattggtatattttgatgtacagaaatttaaaatttatgtagttaaatctttctttaatttctattgcttttgtatttatagctcttgcctagatagtcttaactgtagtatagactttaacagtgttttctttcttttcttttttttttttttagttgcaactactggcccttcagtatattatagtcagtcaccagcatataattcccagtatcttctcagaccagcagctaatgttactcccacaaaggtaacaaaggaataatttatacatttataattattttctttttaaattgtttagggttccttcaaataaattcaagagagcagttcactattaaaacttttatgtcccttaaaatgtagatattttaaatttatctccaaatacagaaattatccttcttagtcaccttatttttgtgttaataagtgtgaatatttagaatattttaaaaatgggagtggtggtggtggatccttcatcgttctgttttaacagaaatagaactgtaatgcccttgctgacccactatgtggtaagtactttcaggcctgatacagctatatatataacaattgattgaagactcaatattacagtggtagttgaatgtgacagctttgaggacagagtgttggggtgcatttagacccttgttcttctgcttattttgaccacaggcaagtttcttaacctctcaatgcatcagttgcctcatatgtgaaatgagggtaataataataccttaattcatagggtttttgaggatattaaaatgagataataatgtaaagtgcttagaacagtgcccagctgacacattaataaatgctcaataaatgttatcatcatcatcatcatcattattgttaacatcatttgataaattgtttaggaatgaagaaggtatttatttcatgactattttgggcatgtggatcaagaaaattcaccttcatttatgtttcagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaagggtaggtactttgttgttaaagttaagcacaatttttctttcttttaatgtttagcttgatgcagactctttgtgggatactaatgttgggatataaacgatgctttgtgaacacccccaaaatatttgagcaattttttttctcccttaataagttcacggtgaggtttcaaagagcaagagaacttagttaaagacatttcagtaactggaagatacttctatcatgctagggcagagcaaaagaacttggtacagtgtatggactcatgcttgaatcatgcgcattaacgtgagtctttttttaaagtgttcattttcatttgttctgtttcttttgtcactcagaaaacatgatattgaggctgggcacggtggctcactcctagaatgccagcactttgggaggttgaggtgggcagatcacttgagctcaggagttcgagaccagcctggccaacgtggtgaaaccctgtttctactgaaaatacaaaaatgagccgggcgtggtggtgcgtgcctataattagcagctactcaggaggttgaggcaggtggatcgcttgagcacaggagatggaggtagcagtgagctgaagtcatgccactgcactccagcctgactgagtgagactttgtctccaaaaaaaaaaaaaaaaaacaaaaaaacaaaaaaaaccatgatattgagatgttctcattttatgtgttgtatgtcagtcttgctcatgtattaaatgagcaaagaatgaaactacagggataaatgaatatgtaagacagtcagattggtggtataaattgagggattctggctttttatgttttaaaagcatattcattttgtttcctaaaatgttaaaaaatgaaatattctttattttctaggatttaattttagcctttttaaatctaatcccatggccttttggactagcaccccttcctcacagcctgagagcaaaggtatagaactagcattctcagtatgagataacagcagtttttagcagctggtagcccttaggaaagtattaataactgtggctgtatgaaatgaagtacttaccactacaacatgaatgttaaagaatgccagtttaagcaaagtaccttttgactggtggcatgacacccttgttggtttgttttttaaaatgtactgggatgctgatttgtaatgtacttcattgctctgctatttcaggtctgctcagtgaagacctatgttttatctaatgtttatctttagccactaacgtctgccagtattcacatgtagtggcaacggcatgtatacagtatggaagagtgtccctgtagggctgttcttttgtgcatggtttagaaaaatgttgtatttgaaaatggaccccatttttaacagccagcattctacagcttgcatattatatatgttgcacagatcatttttagaagtgtggctactagagtggaacaagaagtgggatctgttgaaggccttcaagaacaggttagggaagtgaaacctcacccttagtgaccagtaacacatcttagccatgccaaacaagtacaatgataaaataacaatctctgatttttttttgagtataccagttttattaccagctaaggtagctcttaatcttttattttaaagatacggtctttgagaaatgtgaaaagtgttaacttaaaagtggatgtatacttgcgtacagtttctgtgagctctaggttaggaatccctgacctaagaacgaatgtgcctatacactactgtagaacatagagccttattctgttttgaatctgataatgtcattgtcccaagggaccttagaaatgaagactttagacatgagtaaactgaggccaagagaggctatctgatttacccaagaggtctttactgagtaatagcagaagtggaacaagaatctgtatcttacggtgtactgttatttctcctagctaggaaatgatactaggttttcgtttataatgaaggagagggacaaatttaacattgtaaaaggaagggcactggttctgcagagcagtgtcatccaatagaaataaaatataacctgtgtatgtaatttaaaattgtcatttggtgcaatggcttgtgcctataatcccagttacttgggaggctgaggcagagggatcacttgagcccacaagttccaggcttcagtgaactatgatcacatcactgcactccagctctgggtgacaaagcaagaccgcatctcaaataaatacataaataaataaattttctagtagccatattaaaaagaataaaaagaaacagttaaaaagggaaacagatgaaagtaactttatcgatagatttgatttaactcattatgtccaaaatatcattttaacttctaattaatataaaaattaatgatattttacattattgtttttcaccaagtcttcaaaatccagtgtgtgtgtttacacttactgttagcatgtcttgatttggactagccaccttgtgaggttttaatagaatgtggctaggctaccatattggacaccatagctctcagaatgtttccctgtcaccagttggtatacatggcatgcttcataactggcttactttattaaactcctttagccagaagttgttctttacattaatagatcagaacaggttgcatatagaagttttttctgtttctaattttttgccctttgcattgatggtggctggggatgggttgttttcagccatatgaatggtcttagattttatagtgttagctacccatagagtaacagtttttatttaattttatctagtatcatgcttgaacacaggcaaactagatgcaactctagtcaccttccattcttggcaattgttaactttccttacaggaactaatcacagttggctttggattagtttcatatgtatactaatacttgcttatgttttaagatttttttcaattgctgcaaatgcatggatattttggtaaactattgtatgctaagtatagttaggcaacactttaaaatttttaacctttttaaattctagaaatttgtagtaattcttttcaatgactattaagtaaacacaagatttttttgttttctttcgttttaaatagattctgtgttcacttagggtttttggtagaaaactaaatcaggatgctaattctaattcatgattatcgtacatctctgcatcaaagtatatgtgttttttatcagtatgctgttttaacctatagataggttccatggtttttattttcaggtagagtattaacgtcaatacttaataccttatctttgtcaatttttttgactggtgttacagcaaaagagaagaaaaaacctgaagattctccctcagatagtctcggtctcctgacctcgtgatccacccgcctcggcctcccaaagtgctgggattacaggcatgagccactgcgcctggctgacacatgtcttaattctggtattcaccagatttgtttcgtgttctccgttgttagtcatcaaatttgtctactttttaaatagaaacattagctagagcaaggaacttagaaacactcaagcagcactgaatgtgtagaattgcataaccaatatagcttctttgctttcatatttacaattagttggagttttagttcagccgtacccagtatcttccattctgcttccaggaagaaatggaaaaatgtcagccatgatgatgcagtattttagtagcaagttgatggtgttttggtttcccatgggaaatattgtcactggagcattagcagctatcggtcacttattagggtaaaaaagcaacttcagaagaatttaacatatgccaaagaatcaacaaaggaagtaatcagccagggcaaaggtcgcacaagagattgtaatctagcaatcagcagtggaataagcagtcagcttaccagaaacccaggaaaatgctttagaaagggcagtcaggactaaggcaatttaatgaaatgcaaaataaatgaaatctgaagtttaaaaatctagattacaattctggtttctaactcagttatgagaccttgggcaaagtcattaaatttctctgaacttcagatttttgggagtcaataaaccaatacatgtcaaagggcccgataaactttacagtttagaccaggcgtggtgtctcacccctgcaatctcagcactttgggaggccaaggcgggtggatcacatgaggccaggagtttgagaccagtctgaacaacatggtgaaatcccatctctattaaaagtacaaaaattatctgggcgggatggcatgcacctggaagtcccagctacttgtggggctgaggtgggaggatggcttgagcctgggaggcagaggttgctgtgagccaagatcgtgccactgcactccaacctgtgtgacagagtgagaccctgtttcagaaaaaatatagtttatcagcaaacaggaaagtcttgctaggcaacgtaattgattagttctgtgccctggattctgggctcttaactgtatgagcactgtaggtgtgagcagcaacaattaagaagctgcagaggtaaaggtataagggcagtgattgaggatgtctaccaagcagatttcggcaagtgtgtttcaagaagtatgccgcaatctgaaatacctaatcctgaaaaattgctagaatctagtcttttaattttggccagtatttagcagtagtttggccctctactctaaattaataaaaaataagtagtactatattatgagctgtgttatctaacagtttatcttagctagtagcaattaatttatagctgctattaaaatgactaacgtagttaaaagtttgatgactaagtttttttttgtttgtttgtttgtttttttgagctggagtctcgctctgtcgccaggctggagtgcagtggcatgatcttggctcactgcaacctccgcctcctggcttccagcaattctctgcctcagcctccccagcagctgggattacaggcacctgccaccgtgcctggctaatttttgtatttttagtagagatagggtttcaccatcttggccaggctggtcttgaacttgctgacctcgtgatccacccaccttagcctcccaaactgctaggattacagatttgagccaccacgcctggccttgatgactaaattttaggaaatgttttagcaattcttcatacacctttcacttatagttacttaattcctctactcttatcatttgatattttcattttattgtgtatctctgtaaggccgaatcaatagattttgaacaatctcacacttaacctttaaaaaaaatctaataggcccagtttcctctcagcaatctttgaagaaccttcgagaaaggagaaacacagacctcccgcttctagacatgcacactgtaacccgggaagagggagaaggcatggagacaactgattacggagtctgtgtcttccgccagcacatacacacagtctttagagcagctgcttaattctcccgaaactaaacttggtctgttactctgtctaaatatgttcttcttctttaatttcactgtcttatttaattactattacactaaggtacatatgcttttttgggctgctccaataaaatttctttcaatattccactacctgtttgtattagggttctctagagggacagagctaattggatggttggatggatggatgagatggatggatggatgcttattaagtattaccttacacgatcactaggccatctgcagactgaggagcaacgagagccagtccaagttccaaaactgaagaactaggagtctgatgttcaagggcaggaagcatccagcacaggagaaagatgtaggttgggaggctaggccagtctcgccttttcaggtttttctgcctgctttatattcgctggcagctgattagatggcacctaccaggttaagggtgggtctgccttccccagcccactgactcaaatgttaatctcctttggcaacaccctcacagacaacactcaggattaatactttgcatcctttaatccaatcaagttgacacccagtattaaccatcacactgtccaaatggaaaaattattaaacaaatcttttttaaaataaaatgctagctcttgccctaggcttgaaccataaataagtggtgggaagtttatagtcacaaataggtggtgggtattagaaagcaggataaactatcctctcacccttccaagaaactgacagtttcagtttattcctcttgatgaagtaatgctaaatttttgtagtgatgttttggtatattttattacctgtaattaatattactgttcaaaatttagggggaatctgtcatcttcctgaaacttcagaatcacctggagtaagggtcatttgtattcatggtcactgaccacatggggtagaaactgcaagtcatggttccttcaggcaaagttaatagtggtgacacggaggcatcatgatagagcagcagactccagaagccaatttgactttgtgatttctgaaaaaattacctgtcaactgtgagcctgtttcattgtctgtaaagtttgaataatgatacctaccccgcctgatagaagattcttatgagggaacatgatacgtgaccagtaaatgttaatgctttccttatacgtgaaatgacataaaatcttggaatattaatagatgggaagaagatgtgtaataaaactgtctataaacacaattctgacaaatttcagaactgggactcatagggcttgtattcagttagattacatgctttacaacagagatactgttttatttgtgtcacctacaacatataatctgttgattgaggtatgttgaatagatgaatggcaaagaaagcagacctataaaatatcacatagtaagatatttatatttagatttttcttatttagaatcttcatctgtaatgtatgattttgaaaattaattcttggaacaacatgttgcagagcctccattatggcatgctgaatttaccaaagaagaattggttcagaagctcagttccaccacaaaaagtgcagatcagttaaacggcctgcttcgggaaacagaggcaaccagtgcagtccttatggagcaaattaaggtgagatcagaaacctggccactgtgaaaaccgccagtttggttttctggaccctccatacacatgcacccaagtttaaaaattcacattgcagatgcatctataacgtcttgatctttatattagattattagattcctgatggtgagaaataaatattgccttttttttttttttttttttttttttttgagacagtcttgctctgtcacccaggctggagtgcagtggcacgatctcggctcactgcaagctccacctcccaggttcacgccattctcctgcctcagcctcccgagtagctgggactacaggtgcccgccaacatgcctggctaatttctttgtatttttagtagagacagggtttaccatgttagccaggatggtctcgatctcctgacctcgtgatccacctgccttggcctcccaaagtgtgggtattacaggcaagagccaccgcatccagccaaaatacttcttttacacctattacataaagattatttcttaattcctacttttcctaagaaaccgtaatagatttagaaactagagagatgttcacaaatcattgttcacatatgcttaaataaaaaatgggtgtgagtctttgaattctaaagataaccagtgaatttaaattattcaactgatatttatagtactgaactactaaacagttttcaggtggagatggcaaagtggcatgggaagtttttcctgtttaaagtagacaccagaaacatctaggaatgttgcagaacagttgaggattactcaaatgaggtatttccaccctggctcactgataaatcacccctcagaatatagtcatactgcttattgaggagttcttatgacccaggccctgggctctacatacattatttaatctcatcactggttgagagaaaaattgaagctggtaaatggtggaacaaaattcaaactcatagctgtctgaaaagtacatgcttttcccctgtactttgctgttcctagtagatctgtcctgccactgtgcaaggccactagctatccttgtcagattattttaaagccgaattcagttattttcagtaaattgtatatatcatgacattccaccattaaatacttcagtatgcatctctataaaatagcattttcccactaataaaaacattatcatagctaacaaatcactaactagcccagtaaacctaaatgacttatttaaatgttatattttcttttttttttttttttgagatagtcttgctctgtcaccaggtttggagtgcagtggtgcaatctcagctcactgcaatctccgcctcccaggttcaagcgattcccctgcctcagcctcccgagtagctgggactgcaggcacgcaccaccatgcccggctaattttttttattttactagagacacggtttcaccatgttggccaggacggtctgaatctcctgacctcatgatctgcctgcctcagcctcccaaagtgttgggattacaggcatgagccaccacgcctggccaaatgttatattttcataaatttatactctcttcatgatttctttgtcttctttattgtcacttttttaaatggtcctaggtttgaggacaaagttcgctaactttcttgcctaacctaaaatgaaaatatactaaaagctatggcttggtttcaacctggaaatcttcctcaaagacttgaacatgatactaccttttttatatcgttctttgcctcatttctctgatagtgttttacattgtcttatattcctgaattttcactgtgtctgaactttttaagtgccgttcactgtggacgtcttaactgcctgggacttcaggaacagcgtaggggcagggggttagtggaggctaccgatgttcccctcagcccattttcagagccccatgccatactggcttagtttctatcaaaagtagaaggcagagggaacatcttggtaccaacccatggctccagttagttgctcctcatggagacgttccatcagttccccagctttcaactccatttccatgataccctgtgcttctgagacaagaactccagtatttacacaggatgcatcctctcctcttgtcagtgatacttggtaagctgctggactgactcatttccacctcttcatctgtttctcgtgagaatgtcttgacgttatctcatctactttttctcctcttgtattagcttgttgcttttctacttcacccctcttccttccaaccccaaatagcttaggacaatggagtcatatagcccaacacttggttcatatgcagcaatccactttctaggcaaatgcagctttgaaactatctcatagttggagttccggttttcatgtcaaatggattttatacggtgatgtcataaactcctttgaaatgcttcacatgcagctgctgtagttaactgaattccttcctttattgccatatggagggaagggggaaatttggggggaagagaagaaaaatacatgagttcagtctgccatatttaatcagaagctcctaaagcccatttttaactcatttctctaacaccagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtgggtaaaaggagagtctcagaacttctgacttctaacttaaactaaacagcctggtggttgagaagttgtctgtatgtgtaacttttcaattttgctcatttgaattgggtctgtcatatgagtaggccgtgactagatttgaaaagctgactttttaacatcttgaggcaactgtagtacatttatataattttaacattcagcaaaatacaataagtgcttagcttgatcttctagctctttgaaaattggatttttatcctggtgttgagttctggtgttcagctgaacgtggttttgttttaaattctactttttaaaaaacatttattagcttgttccttttctacttcacccctcttccttcctccaaccccaaatagcctaagacaatggagtcatatagcccaacacttggtctatatacagcagtccactttctaggcaaatgcagttttaaaactgtgccataggccaggcactggtggttcatgcctataatcccaccactttgggaggccgaggcaggcggatcacaagatcaagatactgagactatcctggccaacatggtgaaatctcgtctctactaaaaatacaaaaattagctggacgtggtggcatgtgcctgtagtcccagctactcaggaggctgaggcaggagagtcgcttgaactcacgaggtggaggttgcagtgatctgtcacgccactgtactccagcctgacggcagagcgagactcccatctcaaaaaaaaaaaaaaaaaaaaaaaaaaaaaaaaaaaaaaaaaaaaaaaaaaaaactatgatgtagttagagttggtttccatgtcagatggatttaatactgtgatgtcattaacttctttgaaatgcttcatatacaactgctatagttaactgaattcaagctgcatcttaagaattatggtttcatttttgttttagttttaaattacttttatttttgacatttacaagcacaaggaagacgctataatctctcttgagttgtcacccatctctaacggttttcaactcatggacaatcttttggcgtaaataggggagagttagagacttaaatcccacacatcatttctttccccagtgaataattcaatgtttattggatttctctgtcacctatacctagtttatgttcattttgcctgtgttattgtgaatgtctttttatagtatcctaaatagggctcatatattgcatttggttgatgttccttaagctttattttgttgttgtgtttttgtttgtttgagacgtagtgttgctctgtcaccctggctggagtgcagtggtccgatcatggctcactgcaacctccgcctcccggattcaagcgattctcctgcgtcagcctcccaagtagctgggactacagatgcacgccagctaatttttctatttttagtagagacgaggtttcaccatgttggccaggatggtctcaatctcctgaccttgtcatctgcccgccttggcctcccaaagtgctgggattacaggtgtgagccaccacgcccggccattttgttttttttatctataacaattacatatataaatatatttttaatgtgccacttattaattgaagaaagtggtcatttatgctatagcagtcctatatttggtttttaatcattacagggtaacactgagcttgttctaattgcctataaataggaagatccaggtgcaattgggtgggatggtggacaaaaatacaccatagatggtattgtgtgctttctaagacatcaggaggcccagaatgtccagacatcttacttttgactgattgaccttatctagttggtgctctttaacatgttccccatcccctgtaaatcctaataactaaactgataagagtcatcctcaaaattgagcaggcatctgaatcatctggtatacttactaaaattccaattgctggtccccaatttctgacccaagattctgcatttttagcaattcgttgctgatacttctggtctggggcccataccttgagaatccctggtctagaggcctgataagattcaggcttaattttttttacagacatacttcataagtagtattgatagtttctttgaatctggtttttaataatctttctaatgatgaaggaggaatgttctcaatactgacagtaatctcagttcttcaaactataggataggtttctatagccacaatagtatttttgtcacaagggcccaaataagaatacatcatgtatatttttagtagttattcaaattacaggttcactgtctttaatttattctaacaaaagtaaacctaattttatagttataaaaaagaagaaatctacttctagtcacctaagagtaaaactgcccctataaaaaacaagacagaaatctcaaaattataactaattttatagttataaaattaaccaggactttaagaatgtttgcattttaaaattaaagttttcaatacaacaatgatattatctcaaaatactcagcatgtctaacaggtctcttttaaaagctcagcatgtttaatgtagacgttgctaacgtccaggtggctcctataagttaagggtccattgatttagaagttctaaaagagactaacctaagggataccaagaacagatatttttaaagaatttcatagaggagatacacattagaaacccagaactctaagatgtgcatttggtaagtcctgtaaacagacaggaaaacacatttaaattagtttgccctttaaagattatttcctacttgtctcttatcaatgtgagtacataaaagagaccttattacaattaaaaactgatggtttagcagcagatttagataccttacattttctctttaagagagagaatgtaaggcctggcacggtggctcacacctgtaatccagcactttgggaggctgaggagggtagatcacctgaggtcaggagttcgagaccagcctggccaacatggtgaaaccccgtctctactcagaatacaaaaattagctgggcgtggtggtgcatgcctgtaatcccagctacttgggaggctgaggtaggagaactgcttgaacccaggaggcagaggttgcagtgagccaagatggtgccattgcactccagcccgagcaacaagagcaaaactcttatctcaaaaaaaaaaaaaaaaaaaaaaaaatgtaaactacaagatagttcaaaagaaattacacagaattcagcatgggagaaacaaaaaacaagagtgggaaaagacatcaaacatgtttttactaatcgaagttctaaaaggagagacaagaatacagcacagataatatatgaagagaatggctggaaatctttcagaactgttgaaggatatctatccacagattcaaaaacccaataaaatctcaagcaatattaaaaaaaaaagaagaaatctacttctagtcacataagagtaaaactgcccctaaaaaagacagagagaaatctcaaaagcagccagagaaagaagacacattgcctcacaatagacttctcaacagcattggtgtaatactatctcatgtactaaaagaaataactgccaaccttttatattttccaagatctcttctggaaaacaaaaactttaagaatctgccttcactgaaaattcttaatgatgtacttcaagcaaaaagaaaatttcctaggtaaaagttctaagatgccagaaagaaagacatgcaaaggaaacttaccaccatattacagatatggactgtcagtctgactggtcacactaggggcatttggttaccaaggccttgaaaataataaccaacactgcatacatgagggatgccagaagaaaggtctgagagccactcttcctggcactgaaggaaacagggcccatcagagcaaacaagtaccttttacctctctccttggaagcaaatgtttataatctctggttttgtgtaaagtttataacagtatttttcattcaggttgctacctattagtggatggtgaaattaatttggtggatcacattcagaatatttttttaaaatcaaaagaatacaagctggggtcagtgactcacagctgtaagcccaaaagtttgggaagaccaggcaggaggattgcttgagaacaggagttcagaatcagcgtgggcaacatggcgagaccctatgtctacaaaaattttaaaatataccagatctggtggcatgtgcccatagtcctagctactcgggaggctaaggcagcaggattctttgttataaggagtttgaggctgcagtcaaacttctggtcgaaatcctggtcatgccactgcatttcagcctgggcaacagagtaaaaccccatctttaaaaaaaaaattaagaaataaaaataatatgtgaaacattagaatatgttgaatctagtaaggataagcaattatttcttgaaactctacatatatacatgagtgttggtaaatacctgactgtatcatcagctctagatataaaatgtttatgatgttggctgtgagttaatgaggaatagttttcctttctgtgggtttgggtgtatttgggaaacattagctaagggggtaaagtaggttacccaactctgaaaagcagcatcaaaatctttataataaacacatactaggggcccaacttaaatttcaagcagatgtcatgagctgctcagagtagcatgttacaactctgcgttataaggtaaaatgacacattgcctcacaatagcctgccagatctgagaacacagcaaaatttttattttgtcaaaaatctcatattcagcttacaccattcatttcaggtgaacatacaacagtgcatttcagtttagggaaatgtttacagtcatctggttctctttattcctgggaacaaggttacctcacttggaacacataaccagtgccaagttgtccatccctaagcaatattgcttccttctactttctagaagttcttcagattgtggaagagaaacttttcagagttctttgccctcattccctcctccagaaattcatgcctttgtataatctcttccccctgagagccagtaggctaacctaatgagttatttttaaccagtagaatacagcaaaaatgatagattacaagagattgtggcttctatcttgctagcggactctctctgtcttctctgcttgcacactttgttgaagcaagctaccatcccagaggcaaggaacacaggccatcagtttagcagccttgaggaactaaattcttccaactaccacataagtttggaagtagattcttctccagtccagccttcagatgagaccccagccatgccaacatcttgattgcagccctgtgagagaccttgaaatagaaccatttctgatctcctgacccacagaaactgtgaaataaatatgtgttaaggtactaagtttgtagtaatttgttacacagcagattgtaaataacacgtagataaaaccagacagaacagaaaaataaaatggctttaaacctagaaagtttccccatgtaaaattttgaaaatgctactctgcctaaggtcaaaccgtcatacatatatacgtatgaaaacacagaaaggtgtctggaagggtaataccaaattaaatctttatccaagaggaatgaaaaccagtattcacacaaaaacctatgcacaaaccttgtgaatatattaaaaaccagtgacttatgcactttaaaaaggtgaattatgtggtatatgaattatatctccaaaacatttaattaaaaacctgtacacaattattcatagaaactttctttaaaattgctaaaaacgaggaagatctcagttatccttcaactggcaaatgaataaacaaactggtacagccatgcaattgaatactgctcagcaataaaaaagaatgcactgccagtacagcaacatggataattctcaaatgcattatgccagttgacagaggtcagactcaaaatactatgtacagtgtgattctacttatatgacactgaaaaaagcagtactataaggacagaaaacaggttagtggttgccaaggagtgggagaagcagccagggagaactttgaggaggtaaaaatgtgccaggccttggtcggtggtggtacataactgtgcatttgtcaagactcagtgctatacgctgaaaagggcaggttttactataagttgtacctcaataaacatgatttttaaatgattaaaactttggtttttgtttgttttggttcagttttaaggtttaccataaatctattggttttagattctaagttgtatataagcttctgttttaaaagaacttttttaaaaatcctcttatcatcaacaatatttagttgtgctggaaattttattttggaattgtttaatagagaaagacaataaataatgttcaagaacagacattgattcataacatcaaagtatattgtgagaagatggtatttcagaatagaggaagaatttcttatgtgctggtaagattgtagataatcatttctgcataattttcatagctggattgctttaataaagccacttaaaggttaagttctagattgcttcatgttgcttatcaatgttttaaagctaaaatagaaaattagctgttaagttggctcaaccggaaattcagtatatcctttaaaaagagaaatttagtaagcagtgtgtctaaagaatgacatatggttgggtacagtggctcgtgactgtaatcccaacactgtgaggctgaagtgggaggatcacttaagcccaggaatttgagaccagcctggaaaacagcccagcccagcccatgcctggctaatttttttttttttttttggattttagtagagacaaggtttcaccatgttgcccagctggtcttgaactcctgagtgcaggcaatccacccacctcaccctcccaaagtgctaggattacaggtatttggttttttgtttggttttcaagcaacctttctcaattttgctatgctcactctttcttcacatgttggtactggctagatacagattttgctttcctattggagactcttttgagagctggctattccctcttgctccttttcttttttctcttccctactttcaagtttcttgctctttttcttaccccataagttaccagaaattcatacccccttgagagggctttttctttgaacttcagtctttagtttcatcaacttttctaaggaaattgatctgttaatgaaagttggcttgcttgacttcagaatatctgtattattcaatgatgtgtttttctggttgctttgtttgagcatagtgtaaatatcacccattgcatagctatggcagtgacataaatctagcagcgtaagatcgagaaaagctagaagtcccaccacagattgtatttcagtgaaagggattcattttaactgcttataaaactaaagaaaacttataaacatggaaaacaattattaaacccaccatatgctcatactgatattaaatggtgtgccagattctagaaagagttaccttttggtaagagcactgcttgttaactatggttggttgctttagatgtctagtgtgtacacaaaagcatgaattttattccttataaccaaagtagaaacctactctgagcaatttgacaaaaggtttacattatttattttagtgtagtttaagattacagtaagatgcaattcccaaagagtgaaatataaggctgggcatggtggatcacgcctgtaatcctaacactttgggaggctgaggcaggtgcatcacctgagatcaggagttcgagaccagcctggccaacatgacgaaaccccatctctactaaaaatacaacaattagccagatgtggtggtgcccacctgtaatcccagctactagggaggctgaggcaggagaatcccttgaacctgggggggtggaggctggagtgagctgagatcatgccattgcactccagcctgggcacactctcaaaaaaaaaaaaagtgcaatataacttttcacaaaatatggaactgtggtagtctagaacaatgtctcaatatacctcctacacgaagtataatagtaaatatctgtatttggtggcataatatgctcttagtataaaccaaaaacacatgctgagcattggacattgtccaatgtttaattcatatgattcattctgagtttctgactgagatcattctttcagactgtgtatttctcctgggatccataaaatatgcagccctaacatgatttcatttttgtttcctttcctggaaaaggagaaatcattcagatcagctttcatattgccttatagacgatgacttcaaaatagttttaaagggactcctttgttctagaactgctctaacacagtagccactagccacatgtggctattgaaagattgaaatgtggttattccaaatcaggatgtacagtaaatataaaatacacaccagatttcaaaggcttacatgaaaaaagtaatgtgaaatatctcactagtagtttttatagtgattacatgttgaaattttaacattgtgaacatattagtttaaataaaatgtattgtgaaaattaatttcatgtttctatttacttttgataaaagtactactagaggctgggtgtggtggctcactcctgtaatcccagcactttgggaggctgaggtgggaggatcacgaggtcaggagaccgagaccatcctggctaacacggtgaaaccccgtctctactaaaaacacaaaaaattagccaggcgtgttggcaggcgcctgtagtcccagctactagggaggctgaggcaggagaatggcgcgaacccgggaggcggagcttgcagtgagctgagatcgtgccactgcactccagcctgggcttcagagcgagactccgtctcagaaaaaaaaacactactagcacatttttaaattacttgtagtgatctcatttgtaacacattacatttcaatcgtatactgcttttctaaagagtcactgctaagccctgaaattaactccaaatacctccctgggatacagtgccaaggaaggggcttccttgaacttcaacctctaaaagtaagcaagaattgagaaatatcttctgctttgaaaaatattcactccccaacgctaatacatcaattacatattatttgggggctaactaagctcctattttaaaatgtaaactgaagaaatcaggccagagtcattcccatcttagtgccaatcatataatcagataattagattgctctttccctaaagcctgtttagtttttttgtttgctggttttgttgttgttgggttttttaatttgtttttgttgttgttgttgttgttgttgttttgagatggatactcactgtgtcacccaggctagagtgcagcggcatgatctctgctcagtgcaacctccaactcctgggttcaagcgattctcctgcctcagcctcctgagtagctgggactgtaggtgcatgccaccacgcccgtctaatttttttgttttttggtttttttgtttgttttgagacagtctcgctgtttcccaggctggagtgcagtggcacgatctcggctcactgcaacctccacttccgaggttcaagcgattctcctgcctcagcctcccaagtagctgggactacaggtgcatggcattatgcctggctaattttttgtatttttagcagagatggggtttcgccatgttggcaaaactggtctcaaacttctggcctcaggtgatccagccgtctcagatcaaagtgctgggattacaggcatgagccaccactcacagctcgctaaggccttttgccaagacaaattagctcttagagaaccacaggattccttttgtaatgtattacaaactaaagtcttacctactcttgaagagtagaaaacatggaaaagttctatgttagcccttagaataattaaaaattcataagctctgaaataaagacaggtaataaaatcattgcgtatgacaaaacaaaagtttaaattggcgtttgtaaactctgcatgaaagccaggtttctcactactagaaaaaaagttataaataaaccaaggagaattccagaatgaatcctgtggtgccaaatatatgttaactacaaggaataacagtgaccttacactggaaacaccttaaccatgggccaaggttaaagatataacagcattctcacaccccttgcatagctacccccaatgttaacataactgttaacaaattatcaaaactaagaaattcgtcttggtatagtatcactaactaaactccagacctcagtcaggttttcccagtctttccttcagtgtccttcctctgtttcaggattcaatccatgatccttgacacttggtactttgtcagatgtcccgctgtatgggtttgtttgatgttttcccatgattagggatagacactgcaagactcagagctactttacaaagaagcctctagggagctccccagagaagacaggggagacaacacaaggacactagaggaaattttagcctctgacatccatgactatatagcaaagagtaaacaaagcctaactcctagccagagaaacacaaaatctcatactaaagccttatttaactcagttcgtttcacccagtacatcatatacagcctcaaacaaaaaattacaaagcatactaaaagacaagaaaccccacagtttgaagagacagagcaagcatcagaaccagactcagatatgaaagaaatatcggaagtatccaaccaggaatttaaaataactaagattaacatgctaggggctctaatgtaaaaatggcataacatgcaagaacagatgggtaatgtaagcaaagagataaaaacactaagaagaaataaagatgaaatactagaaataaaaaacaccataacagaaatgaagaatgcctttgatgggttcatcaaaagaatggatatggccaatgaaagaatcagtgagctcaaagagatgtcaatagatacttcaaaagctgacacacaatgagagaaaagaatgaaaaagaaaaaacagaacaagagtcaagaactgtgagacaattacaaaaggtggaacatggagactttttggaaataccagaaagagaagaaaaagagaaagaaagccaggcatggtggcttacgcctataatgccagcaatttgggaggccgaggcgggcagatcgcaaggtcaggagatcgagaccatcctggctaacacggtgaaaccctgtctctactaaaaatacaaaaaattagcggggcgtggtggcaggcgcctgtagtcccagctactcgggagactgaggcaggagaatggcatgaacctgggaggaggagcttgcagtgagctgagatcgtgccactgcactccagcctgggcaacagagcaagactctgtctcaaaaaaaaaaaaaaaaaagagaaagaaacagaagaaacatttgaagcaacagtgactgaaaattcccccaaattcatgatagataaagctatggtctgaatgtttgtgtctcctcaaaagttatattgaaacttaatcctcaatgtgatagtactgaggtggggcttttgggagtcaatcaggttacgagggctctaccctcaggacagagattagtgcacttatgaaagaagccccagggaattagctagcccctgacaccatgtgaggacaaagccagaatgtgtcatctatgaggaagcagggcctcaccagacactgctagtgccttggtcttggacatcacagcccctagaacggtgagaaataaatttctgttgtttataaactctccagtttatgatatttttgtcacagcagcccaaatgaactaaggtagacataaaggaacagatccaggaagctcaaaatacatcatttcaataatgatctttaaaactttgtttgaaattatactgatcattccgctgactgctgaatgacctggcaccgtctcagggttttagtctggagtttttgtttatgctcatggcctcacggagaacaatattcacctgaagtgacggcgcttctctttttatgttgttgagaagcatgattggctctttttttgcaaaattattcacaaacttaaactttgattcagaattattgaagtaacatggtgaggcagagtaatatgtgacttaaattttatggagtactaaggaaaacgggcagacttaatataaaagtggtgcattggtggtgcttaagggcaaataccgataacatggtgtacaaataaaggatcccgatgattcaaacaggtggaagtgatgggagaactgagttgtcacacagtaccatatccacactgtcacacaaatctcacctttatttattcccttttgcactaacgtagccagaaatgtgaaacgatgacagttttttcagtaggtattttttttttttagtttttatcattgacctttgaggtgcactattaaattgctcagtccattaaaataacggattgctgatttaaaaactggttccttgcttagcttcagcaaaacagcaaagtctaccacattaaatgtatattgtttatttgatttttattgactttgttgtcttattttaactacttaattgcaaatctgtcttggggttaacactgtgtaagagttttaagcataagaagtctgtacttagagtttagatgtagttttatatttgtacatgttgatgtaacattttaataataataattcaggtctgctgggcatggtggctcatgcctgtaatcccagcactttgggaggctgaggcgggcggctcacctgaggtcgagagttcaagaccagcctgaccaacatggagaaaccctgtctctactaaaaatgtaaaattagccaggcatggtggcacatgcatgtaattccagctacttgggaggctgaggtaggagaatcgcttgaacccggaggcggaggttgtggtgagctgagatcgcaccattgcactctagcctgggcaatgagagcaaaattctgtctcagaaaaaaaaaaaaaatcaggttaattctgggatctgagcaaagttttgctcctttccgagaggtgaacacgttacgcaattattaataatatccctgtgggaaggggctttacaacaaattattttacaggtgaagggcagaaatgaaaacattttctagagccactcctgcccttcacactcaggaatgtcgcagtagtcatctctctgttctggatcagtagtatagcaccagggcccctgcgcatcgttgtctggattcctccagtccctctgaggggtgtgtagcaggtgagaatctggggaggatggaagagaagcacttagactatattctaaaaatcagcttgctattagcaaggcagaaggagatgctctcgattcccatctgagattgtcatccaaatgcatttcagctgggtgctgcagcatttgtgtggtcagattttcaatttctctattgataggctgcttctggcacagtagctaatattaccattgctactgtgacagccaagtcttagacagagagccaaaatatttttattgcacagtcaggagaaatataaaggcctcaaaagcctgccatggtcttaattcattccaaacacctgcttttgtcagttgcccttttctctgtaaaaattttcgtagttaacaccattttgtccatgtgaactatgtgccaggaattccactaacatctttccacacattctctcttttagtcctaataaaaaaaaccatttgaggaaggtgttattatccctgttttacagatgagaagactgagtggcaacgtaaaacaaaacaaaacaaaacttgcctaagcataaatagctatgaagaagcagatcaagaagtcaaagttgatctgtctgattccaaagtcctggttttctctgaaatgcagcttgaattattggggatggaggagggatttaaacttattttcagttctagagatgagttgctgtatagagacaaccatttagatgacaatcacaagacttacagtctagaaaggcaggttttatttctggttcttctgtgaacctatttgggtaacccccaccccccaagacctcagttccctcatgaagatgagcctagactacctcataaaaatggcccagagtgtctccatggcccccgatagtctctgacttcgccatttggttgaatcagttttcattaactcacggggaatatttgatctgctcatctcatagggatatagcaaaggcaatttgttgagtgttgggggaatggataaaggtgagtaacactaagttcctatttgataagtgtcattactgagaacttaaggccacctaacaccaaactgggaaaagcacaaaaaaatgcactaaaataaataataggcaagttgtgacatttgaatttcacgtatcttcattttcatttttatattttatttactattttgctccacaatttgagtcaaacatgtgatgagagttctaacttgatatgtttacttcagtcccaaacatagtcatctttggtcttttctcagatttggcctaaaactcgtagtttcattgatttttttttttaactaggcattcttctatgttctaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaatgcttttaacccaatactacgtattatgattgccagtacatcttcattgggacatagtattacagtagacataagacactcatcaaagtgtaaactcaaggtactttgtgaaagggaggtctaggggtcaaggaagatttgcaaaggaggtgatgattgagctgacacctaggcgataagaaggagctggcacagcaggacaaaggtgaagagggtcccaggcaggagggcgtgtgcttggggtggtgaaggaacagaagtaaggccagaaactttgtagaaaagtttagcaagccaagcaaacagcagccgggggttacgtaaataatgccgggccctggcacatttgggaagtctttgggtcttattttaagggcactaggaagggctttaaacagggaagttatatttcttcgagatcaggtgtacagctacaagtagccccaaccagtggtgatagggtcttggactcggtgaaggcagtgtggctggtggcaagtggcagaagtaaacgtgatctaacactgactgttcctggcaaaaccctggcaggtaagttagcagcaggtcaatatcccacagcaactgtatgtacccaccggagtttatataaccttttgctcccttctgtcactttgaaaacaagcaaactaagccttcaaacttcacacttcaaactcaacctacagtcattcccatgttccttctggttaacaatttacaaatgacatatttaaatgttagcattttgtagagagaatcaggagaatcagggttttttgtttttgtttttaaatctggtacaattaggtcatcctatttagtttaccgtttgcttgctacttgtaagaactaataactttaccagataaagtttagatttcatctgtactttaatctcaagaattcgagataaatagtggtaaggaagaaagtacaatgcgtacagctaatgaaacccaggaagatgagtcaatgcatagaaataattccaacccaaataaatactatttaaaatgctacttggagttttgccgtgatactagacacaatatggcaaatcatcctcaagaatacaagaactaaggtgtttccagtcctctttaacacctgtgatgcaggatatttggagagctaaattgttattattaacagtcttaatacctggccaccaacacagtagaggaaacagtttttaaagtgtcatacatctcttcaaatattcatacgcttaatgaaacattcgcacatctaaaaaggcatgcaatttctattgaaatcctgtgtgcctcttattctaagcagtgggactattgacccacattttaaaataaactatagaaaaggaactgtaacttttacacatttttaaaagacaacatatcagaaatctgagaaaaatatagaccatgtcccccaaaatgtgaaaaatttaagagtaaaaaataagatttgtgtcccaatctaaatgtttctgaggattaaaacacctcagtatttctgttttacaaggcttcgtccagatgttagggcccaaggaccatggtcaccctgcagaataagaagccaagaccaaaaggaatgcttagacttcccatctccttgttaaatataaaataatattttaaaaatcttattttcagggtcatagaggtagaagtgattttgtaaatctaatcctttcattttttgaacaaaaaaaaattaaatctaggaggtgaagtaatatactcaagctgacatggttagttagtaatcaaatcctgtcctaactcagaattcaattttacaacaccatagcaccttcctcctctggtctcataaattaaagatagaatagagaaagaggaagagtgggaggatggggaggacagtaggaggaggaggaagaaaatgtactcactttacttttcaaataaaactgcatctctcatcctaatgattatggaggacttcctgttttcagccattatcacacattgttgctctttactgtgatattggaatgccctgcagaacgaagcaggaaatccaataagtatttttctttatttaaagaaaacaaatgtttattaataaatgagaaatgctaaagatcattgactatcttgagggaccagagagctcagaattgctgcctctttcagttatttgggcatggcattgatgaagtactgaacaaaatacaccaacgtggcagtaaatcttatctgcccttaccttccctccctcataattttctctttctttctgtttcaactgttttacttcttcttcactcatcttcttaatttttgtttttgggtcagaaagaagcaactctggttgctttgaacccattccccaagatagtccatctccatgacctcccaactctgatcagttcccctgaacctctgtcccacattccaccccaccctggcccctgacccctcccatctccatcccgtggtcctgctatgggtgctcagtctggcatccatagctactttcccaggctcatcacctacacaaagtctctgctttagtcaacttgatctcttaatggtccccctcagaaagtgcagggccgcatcttcccctgccttcctggtgcttttcaagagctctctcaactccaaacccagctcggttcccacctcctccctgagccttctctagctgcctcaaccttaggcactgttctttcttctggatctgggtagaacatgcattgattatgcctgtagctcacttaggctgtcttttttttttttaacattatatccagtcaccttaaatactgaagggcaggcactggatcttgtagctataagtcattgctcagatctatctaggacactttcattcatatgatcctcaacaaacatttactgatgatgatgttaaaaactggagctcagaacaataactgctaatgtttatgtccggtgtaaaaacaaataacttccttttagggtatttttctaatgaagactccagtaaaccttaacaagaagctgttagtatggcttcacatgctatgagcaaatatagttccaaactctggctccataaatttctctttcctcttaaatcgttaataaatttgtgagtaaattacttgccatctgaattacagatttctgggtaggtgcaacgacgatgaaaatacctgcaggtgaattctttgtcctcttcacattttgctgcacattcttctctgcttcctgcccccagctgcttcttagtgacactgaacagtgaaggcccctgggtattcacatagtcatccaggggctctccttgacctagaggtgggagatccaagtggaataaatggtcagtaaatcaatgccaatgtctaattgtcatgacttccttttaatctatttggttagcattaaccaaataaaacttgctgtttactggaagtagaatgggtagctatgaatcaaaatgtttagttaagaacacacagttgggcatgtggacataaataaagatggcaactaaagacactggggactaccagagaagggagagagggagcgaggcaagggctgaaaaactacctatttagtaggtatttagctcactacctgggtgatgggaatcatttgtaccccaaagctcagtgtcacgcaatttagtgatgtaacaaacctgcacatgtacccctgactctaaaagttgaaattataaaacaaagaaaaacagtttcattaacagattgcaagatagtaaaagattaactggattgataaacaggttagaactatggaaccactactatgttaccatattagtggatataaatccttaaacaagaacaaattttatgtttgctatcaattgtgccatgtcatgagagaagagtaaggcaccatcagtggcagttgtgttaccaagattgatgttgatttgttcatccctgggtagaaatggaacttggaggccattgtttgatttcctacaatatgcgctttggttctgacactgtcacttgaactggtgggaagcatcctctgaatggtccctccttgaggcacataaattttggtgcatagatgatggtggaaataaacaagaactgaactaaattatgttgccaccttggacaaaaattgggcaaaacactggagggtaagaagctccccaacaaagaaggccatttttgtactgggctgatgacagtcacacaacactactaactggggagaaatcagtttttccaaggtgttgacaggtatctggatttcggaggaaattgtaaaaaagcagaacctgggacaaatactggtcttggtttttctttgagatcaaatctgagacaacgaatctgtccgaaagctgctttctgcctggtcgtggcagagggtggccaagggggcctcagctgtgctcccaccacaaggctacagggtgttcccttgtcctgaggctcttccggacatctggctgagctttggtaggtctattccaagcctggagatgccagctccatccttcgcacagaatgctagtgattttcacaggggtaagaggccaaaagaggctaataaaatgaagatagccaagctccatggaattagacaacaggacaaccttgaccactttgaggggcgtggtgggggctgcaggcagagggagtgggttatagagtgacgaggagagcagtggaggcggcagcgggagacaagcctggctctgaagacagcgagccctccagggaagatgcggtcaggggaggttctgaaagatgacacactgcagagcacactggtttgtatgctgatgacaaatatccagtaggaaggcaaatgaacagattctcattctcagaaaggcccgtcctgacctcctgagggtacacagagcacagggaggaggatgcacgctcatcaattcatgcaaagtcctcggccaaagtccccctgctccccacctctgggacttcgtccttcctcaatttaagacattccgggctggaaaaatggattattgagcaggagttggctgatgcattctaaacctaatccactaaaaagcacttgagagatgtatcaaaagatcacaaagaaatagatgctttaggcccatatccatgtctttaccccgcactttctgccaacttgaactctcatttccaagaagagttgtgttttggttaattctatagctcgcagtgtgacttcaaaacacacaataaatccacaaagtgtgtcctacggtgagttcagttaaactttctgaagagtttttttgaagtatagcagagcaggctacaattgatattcaaaaaaagaaaacttccatttatttcccccttcaattaagttctctgtgtcatgttattatacttcatagcacatcgctgctgagatcccctccccagctcctgtccctaggaaatatcccaaaacagaatcaaactgttttctttttaatttgaaataattttcccccattttttttttctcttattcacctctaggactcatatggcaataggatttgatagggcttatttgctggcaaggaaacatcaaatcttttagtggaaaaatacatttatattataggcaaaatgcagatgtatattgctactgatgcaaatgtattttattaatggtgtgagaatttcttcctcactgtggtgtgtgaatgtgtatgcatatttgcatgtgtaaaagacttaatttgtgaaatggaagatgtttctccacttcccactaagcatggctgtaaaagaaactttttcctctccccgggcattgcagcacactggaaagatgatacatccacagaaagcctggctttccaaaagagcttatgagagaatgttccccccaggttggttaaaacattggtaatcctgtggcggagaagtttgttctagcctttgggtgtagcccactgaataagttcacagtgatctatgtcatagtttccatgcattgaaatataatattcacacccccaacatacaccaatttcttacaaaaatttctttaattttctcctgctctgtattttgtttgatagctccttgaatggcttccactaaattcaaatgtatttgactctaaagtgcaacttgtaaaattttatctggtaatttatagattgaatttcaagtatacattatttacaggaagaactactagcaaatcgtatgattccgttcgtatgaaatgttcaaaatggcaaagatataaatacagaaagtagattagtggttgccagaagctgcagatcgggggtaacagctaaggagagtggagtgcgtttttgggggtatgaatagttttaaaatttattctgatggtggctgcacaactctcaatatattgaaatccattggattgtatgcctaaatgggtgaattctatacattaattatatctcaataaagcttttttttaaaaaaagaaaaagaaaaagaactactaggacatgtttagaatattatttcaaaggcttaaacaaagctgaaaagtgagaagagccctagattccttctgggaaacctggcttaaatccagttttctttatttcccagatttgagaatttggtcactgagcaaataacatgattttcctaagtctagatttctttgtttataaaatgagggtgaatatgctaccctacctataccgcgagctaaataagctagtatttgtaaaggacacacactcacactcacattcacacacaggtatgtatgtatgtgtaaaaatgtagcgacctaacccaagcactaagtgagtatttgttgaatcactgtctgcacacagcatctggcaaatggatgcgtgtgatttttccggggattagaggcaaacgtatactgatggaaagccttcctcaggccataacaaagggagaaatgctgaatccctgacgctgccaccaccatgaactggtgagagaacagaatatattcaaagagaaatttcattgttttaacttgcaagtgaggggagcatgacaccgtaagagagattatataaattagtcaaactgagaaccaggcgaagagcttagccgtcctttgcatagttagctacattggctctttttcaattagactggccattatgtgggtgcactcatttagatttgaaaaaccacccattattttctctgcgcattcattccagcacgctgacaatcttcacaggaaaactaaacttatttcttgaagaattcctcaatcttatacaagattttcaactgggagtttcatgaatcaaaaattaaatgaattgcacataaagccatggcatatgtatttgtactgcattgtgggagaaaaaataattattataatttaaaaaaactatgtcttacctgatttcagaaataaaagaagtagaagaaccacttccttatgttccattttgggactggccagcagtgcccagaaagtgtgtcccaatcccaggatgttgttgacttacatgagagtaaacgcatccacagaccagatagtcaaattaagttaatgattctctcagacacccacgccactggctcagcagggttcaaacacgaccttgaataaagggtccttacaaaatgattgagggtggaatctgcaatagatgctgggaagtggtgaaagcaatctcccccctcagctgctccatgctgccttcatgtctccttactccttccctcacctttgtactttatctctcacaattagtcttatttcctcccctcttcttttattccctttcttttggagaaaatgaaatcagaaaagtatctcacatttgctggaaccttccatgacgagaccctctgccaagcgctgcacgtccatagcctccctcaagcttcccaacaggcagtgctgttctcattcctgctgtacgagggatggggctgaggccttccccaaggttgtgtcgctacccaggggtgcagctgatagacaaaaccctttcaggtcctggatgacaaacttaagttaggtgtaaatgttaatatctccacatcctacaccaaatgacatagaaattacgacataagtgaaagtatcttattatcttcaaaatttctttattcccagtgaactcacatgttttctgtaattataaattataagacatcaatctttcccccaaatgaacgtatggcatattattatattctcattctcatgaaataaagcaagactggtagcactaagtggaaagcgtctatctcaattttaaatgttgaatctgtacttttccctggcttaagtctagagcaaccaggtagtatatatgttgtaaaacttctattttagtgttcaaagatatttagcaataaatcaattgacctctctattttagatgtgaaataaggaccagaaagcattgttcctctttccaggcagtgaaattcctgcctattcattaactggcaaaagagtagaggtgggagcccaatggtcttgggtggaacgtcctgtggaattccctgggattgaggaatcatgcagaaccctcaagaagaaaccacactgggcaacaagagggtggccccatgtgaggaacagggggaccgaatcgcatttcctgatttcctattctagcctcactctcttctctcctcaaattcttaccactccctttatcctctctgactcacctcgtggcccagttcattaaaggggacagaaggtggaggcaaattgagaaaccagcagtgggcagacgttttatttttaatgtgaaatgtctcttagggggcttatgttgatgtgcttgagaaagtactttgggggaaaaaaaaactaactctactaatatataatgcttccagcatgtatttatttccacttaaaatattattgtagcagttcctcttggataaggcatcttgggaatgatgttatcagaaattctacatccacataattttcttttcctgtttttttggttttgacttgggtagtgttggtatagcttttgcccacctttcccctggtaggtgttagatgcattaaattctacaaatgcgattttataaattagttgccctcctaatggcctcctggctgtacattcttccctaccttcataatccatcagcatcgtgaaagcacagagggacattgagcagagttctgtgctggcgccaccgcactctgtagcctgtaagagagcagcaaagaggaatgagttgctcaggtatagacaggggtggatgcatagagacttccactgtggcacggcccttcatgtccagggtaggcatgaagcaatggactattccagattgtgcataggaaaccacactgcactcttagacggatttttgctctaaagacaactaattcaaaataaggtgctttctacctgaaataatggcatgaactgagaaaagagatatagagagagatctctgtgtactacgatcaggttgcacatattctgagatttatgtattcttatttagttcaattccttatttactgaccacttactgtgtacaatattgtattagattcttttaggattacagttgacccttgaacaacttgggggcttggcacactgaccgtacacagtagaaaatccaggtataattctgattcccccaaacttaactactgatagcctgctgttgaccagcaacagttaataacatgtattttgtatgctatatgtattatatactgtattcttacaataaagtaagctagagaaaaggaaacgtttctaaggagaaaatacatctatggtactgttatgtatttatccatacagtaagtttacaccgcctgtttacaagatgaatcatctgtctgaaatggaagcaaccccagctacagacctcagtctctgttacatatcaagcaaatcaagtttttcttgtaatgtcaaatgtcatgacttttctctgcttcttgggagcacttccagcatcactagtgccacttcatgtggatcccatggtgttattcaaggtttacagtacagcacgaaacaggacgaaaaatacatgtgaacagggagagggcactttttactgggatgcgcaattcactggggatgacctgctcatgatggaatgttgagtatcacagaacgttttaagtggatacttgcaacacctgagctcattgcaacagcaacaggaggaggctatgaacttattaccgtactgtggtatgcactacggttaaatttatgcagttacaatttaatactgcatcttgatgtttgtatacacttctctcaactgagaatagcaccatatacgatctgtgagtgtgtacataagttttactaaattttaacttttgcaatagttttgttatattttatggtagtaaataataaaatagactaggtatctacatacattttatgcattcatgacatacttaactttttctatttttgttgatatttctagctgcatggtttgtctttgagttttttcaaattgttgcaaaactccaaaacattttctaacacatttattgaaaaaaatctgtgtgtaacagttcagacgtgtgttgttcaatgatcaactatatgtctaaagagtacaaatcagtctgtaaccttccccagcctctccatgctaaaggaactacaggaaactttcgcactcaagatgtgtggagattctgctgctgcacttgtagcaggcataagaacgttcaaataggccgggcgcggtggctaatgcccgtaatcccagcattttgggaggccaagacgggtggatcacgaggtcaggagttcgagaccagcctggccagcatggtgaaaccccatctctactaaaaatacaaaaaattagccgggcatggtggcatgctcctgtagtcccagatactggggaggctgaggcaggagaattgcttgaacccagcaggcagaggttgcagtgagccgagatcgtgccattgcactccagcctgggtgagagagcaagactctgtctcaaaaaaaaaaaaaaaaaaaaagaacattcaaataagattggagacaaattgaatttccttagctctgcccagcataaggcctgcaatcaagatccactcaggtcctcttatgaaggaatagacgtctcttccagcattaaaatggtaaattccttgcaagtatttacaaagaaagttataaacaccaggaaacatcaacctcaccaggaggtgaggtagagttcacccttccatctcacctgaagtggaaaatgcagccaagtcacaacttcctaggtgatgcacgtccatgcaagctggactgcattgctggcctgacatttgcacctggcagctcctcgccaccccctctttccaccttccttgagcccaggctctgctgcccgggaactgccattctaggacagctcatttcatcaagatgaacttctctgaatagccctaagaggacagtatcatttccaactggaaatagcaagaacttaattaatctactaaggattcatataaagcatccctctgtcgtggtaagggtcctcggcaagtttatctgtgccctcgatgccaatgtgcaggttgtttttactgctgttttagtgtattagagcatatcagcgaggagacttctactaattaacctggaggtggctcttctttctttagttgctcttttccacatgttagcctttgttcatcagtccccaggaccatgcaatgaggtgcttatcagccctcatgtcccgtaaagagatagcaggctatctctcaagttagcacagtggttaaaacgtaatccactagggggcattttcctttcctttctttctttctttctttttttttttttggaaacagaggctggctctgtcacccaggctggagtgcggtggtacaaacacagctcactgtagccttaacctcctggattcaagcgattctcccacctcagactccagagtagctgggaccacaggtgcacgccaccatgcacagctatttttttttttttttttgtattttctgtagggacagggttttgccatgttacccaggctggtcttgaactcctgggctcatgagatcctcctatctcagtctccagaagtgctgggattacaaatatgaggcactttgcctggcactaggagacactttctcagtgagacctaactcatttggggctcagtgaggtgatattttcttaattgagttgtgcttgaaaaaatctagatatctattcatctttgaaaaaattaattttcattggctgtctcctcatcattaataagcatggctgtgttacatgcttaagacaaatattagcagagaagaagaaagtcagacccggataacttagcagcctgcactgaggtggcaccaggactccccagaggagagacgagggtccttctgctctgaggtccagactcaccatggataaaacagagttgcaccaaatcatccttcccatctctcacattgattgttctctaagctcattcagagaaaaaaaaaatcttatctcacagtatgtcagggagataagtcatgtagaaaaaccttaaaatattttcaggaaagcaaatgagtgcacaaaaaacctggtgaaatctgagcaaggtctgcagactagtttctgatattgtgccaatggcaactttccagttgtaatcatgaactatagttatgtaagatactgcctgagggaggcggggccataggcacaaggatctctcagtactatatttgtaacttgttgtgtttatacttatttcaaaacaaaaattatatgtatatatttatatatgtatacatgttatgtttgcaacacatgtgcctatatttggatacatgtgtctattttaggaggacctaggatgatgtaactgctttcatactagttaagagaattcccaaatttcagggaaagtctaaagttatagagttcctaactcagggtgcagaactcggactttggctgattctcgtgagctcctgggatgagtgggtgggacagagaggcttctccaccaccacactccttccctggctggagaccagatggttaaggactgatgggtgccagagagcagcagccctccatgtgggtccagaacccagaggctggagtagttcatgcctgctcctgcctcccaggtattcaagggaaacccaccatctccacacaccagcaaaacaccagcaaaacagaggccccaagtaatgacttctcctttctcatcttatcttgccacctgaccagctcctgggctcctcaatccaaagttggggaagagagaagggaatgtcagtggaaaccacttttgctataaactctcatccttcagatgttctttcagtgggtacagtgtttagtgctgtgctaggtgctggggaatcaagagtaaataagaggccatctttgccctcagggagtttttggtctcatgggtttggggcaatgcaggtctgtaaactggaattgtaaaagtgaagtggcccaggtcccatttgttgtagtggtgcacagagagacagtcttgagaggtgaggagacatttcccagaggaagtaacatccaagttgagacttagaagacagctggaaggatgagaaaggagaataattctgtggagtcctaattaggcaaaaggaatcaggctggtgacactgaggaaaaaagaaagagaaagcagataagctgtaagtttgcctttcttcatggtccaggaccatagccctcctgcacaaatagctcacaatcttcctgtgcccagctaccatcaggccctcagctgatggaaaaatgcaggttatcccactgcaaccttggtgttatcagtactgcacaaagctctcttcagcacgcagcaaaagcaacatcctataaaacccccagcaagcctttgtctcttggcattcagttcctctcttgctggcctgcctgttgctgccttgcaacatattttcatactttcttcaataaatctgcctttatctacaactgtcttggtaaattcttcttactgcccatggtatactggcctcagatagttgcttcacctgctacacattctttaagcagaagaaatatatgtgcagggtcccagaggcaggaggagcagacagatgagaggaatttggctaacatggggaaatggtccaattgcgcaggcttctcactctgtttcaagaagtttagacttcagccaaagaaaggcagggactactgttactgaaggcttttaaaatccaagggtggcttgatccctctgattgcagcacagtgaggaggtcataggaggtgagagatgagagggggtgaaagaaggcagtggagaaagagaaaaaagaatggattagggggatgttgagaaagtagaattgacatgattttgtgactcattgaatgtggggaatgaaatcaagtatgctgcctgaatttctggcttggacatctggtggacagtggatcattcattaagaaggaatgcataggagggaataagatgaaattggctggggacaatgttatgtttaggaacttgagaaaacccaagtggaaatttccagaagggagttgaatattctggtttagaacaggagttggcaaactatagcccatgaagcaggcttatttttataaatcaagttttattggaacatggccacacccattcttttactattttctgtggctatatttgcaccaccttagcagagttgagcagatgtgacagagacagtacaatgaccagcaagccgataaaatatttgttatcatcgctttacagaaaaagtttgccaattcctggtgtagagcctaggaaagaggtctgagctggagatgtggaatcagcagttgtcagcagataggtgggactgaagcaatgggggtggacaagcttgctcagagagaaaaaaataagccctaggataaagccctcaacaacacaaggacccagaagaagagaattctgtagagatgactgagaacagttagccagaggggaaaattgacagtgtgagtccagagaagccagcaaaagtgaaaattgtaaaaaggtgggagtggtcatgggtaccaaagacttgtgagaaatcaagtgagatgtatcctgtgtatgccagaaggtaagagcaaatgaggccaacataaccttaataataccaatctcaatggcccagactccagcaaagtctactctagctaccgctaccactaaacatatgtaaaactcagtaaaatagcaattttaattaaacaaattcctgacctatctctgtaatactcctttcccaacatttttgcctgcatattctttgattgcctcttcaataatgttgtaatatcatagtctatgagagaagagaataataaactattttggctctagtattttattattgatagatttaaatttttcttctggcttcatagctcaggatcgataatggaagataagttttcaggattcttggcacacttaggaaaatctttatcaaactatttttatgtatgaactgtaagatttggaataattcccagatgggatgagctacactcttttctagctttgtacatttctatttttcttattcaacttttattttaagttcagggataaaagtgcagggttgttacataggtaaacatgtgtcatgggggtttgttgtgcagattatttcatcacccaggtattaagcctagtactcattagttatttttcctgatgctgtctctcttcccatcctccaaccctgatgggccccagtgtgtgttgttcccctcgatgtgtccatgtgttctcatcatttagctcccacttataagtgagaacatgcgatatttggttttctgttcttgtgttagtttgctgagaataatggcctccagctccatccatgttcctgcaaatgcacatgtcatgtgacacaatcgtgatgtaatctatggtcttgcatatttacattacaccaccaggtaaatcagcacgagggaggtgaagactattctgaatctgttttacacagggacagctagcaataaaatacacagaaatgactccataccacataaataaatcccatggaacccaaactcaatgactcaattcttcttttgctggatcctcaaaatgcccacatccactccaccaccacccaacatgagggcagaaagagatcagaattttagccaattacagctaaaatgtctgcttttgtcaaaagcaaatgaccaaatggatacattgccagggcccctccagagcctcagaaagggcctgctgaagttgccttttgctatgggatgaatcaaaccaaaacacagtggcttaaaataagatgaattattttatttctgaattctgaaggtctgctgggcttggccaggtgattctcattcttgtggtctcttatgaggtcagtggtggctagggctgaaaccatctcaaagccttcctcactcacatctcatgggtgatcccagctgttgctggaacctcatctgggactatcggccaaaacactcagaacttctccatgtgtctgggcttcctagaagacactgttcaagtagagggcaagacaatcaagaatctcaagctctatttcaaaacatttcttcccactccactactgctctatatatttttcacaatactttataccttctaacgtaatagttattatagaggtacacgtatgtcttactataacataaactccatgagggaagatatttttagttttgctcaatgaaatatccccagtgccaaggaagcactgccctacacattcatccaaatagtaaaataataaatatctatttttaaacactttgttaattctgcacacatttactttttctaaagggagaaatgtggaacactgaaaagctccttgaatcttagaatttgtttttaattaatagacttaatacatggcataacatgttgtactcaacttactcttcatgcaacgtgtaagcataaatgccaaagatcttactttcaagcatcagcattaatatagcaagttaggaaggtagacggtttggtaattacaaaagctcttgaagtaggcaaaaaccattgttttacatggtagccaagatcacactaatgataagtatttctggcttaaccagtcctcacagcaatatgctaaattaatgaaaacaaacatgggcattgtttgggtgttactgacatcaactacaaaacagaaatgaacagaaattgaaaactatattgtcaaatacaattaaaatagccaaatacatttctaggtaaaatctttataacttcaaatactgccagttttctttcaaaaacttacagtacttgaaagaacgaaaatcagcttaatccagcacaggggaaagaaacacatgagataactgaattttacaaccaaggtcagagaggatatcacactatcaccgtgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaatttttataaaattcctctgataagtatgcttaaaattaacatatttaccaatgtcaggatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccgtgctggaaaagacaataacagacgagtgaaaagaaattttatggaggaagatccataacacatacccataacaaatataaaaatgaactaacttcaaagcaggttatttcgggttttgttttttttatttccaacttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaacctgaactgtaaatatctgaatactttcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcaaagagggattaagcccaaggttatacagctattatagtaagttgcagggctatatataaaacacggccatctggttcaacaatccatgaagctgattaagcaatagacaataatgtagttaaatgacttgactcactagttaggaccagaattcaagttgcaattccctgtgtgattcctttcttttttttttgagacggagtctcgccttcttgcccaggctggagtgcagtggcacgatctcgactctctgcaagctccgcctcctgggttcacaccattctcctgcctcagcctcccgagtagctggaactacaagcgcccaccaccatgcctggctaattttttttgtatttttagtagagacggggtttcaccgtgttagacaggatggtctggatctcctgacctcgtgatccgcccatctcggcctcccaaagtgctgggattacaggcatgagccaccacacccagctgattattttccattataccaccagcctctttagctcacgtgccaatgtgaattcaaggccctaatagatggtcaaccacgaggtggattttcagaacacacatgagaaaaaattccttccactacaacttttttttttaagatggagtctcactcttgttgcccaggctggagtgcaatggtgtgatcttgattcatcacaacctctgcctcctgggttcaagcgattgtcctgcctcagcctcccgagtagctgggattacaggcatgcgccaccacacctggctaattctgtatttttagtagagatggggtttctccatgttggtcaggttggtctcgaacccctgatctcaggtgatccgatcaccttgccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcctgatcatatacattttcactattctctgttttcagtcatagtgggctgtcacttattcattctatgtcttgaacactttaaaaaaaaaactttattccctttagtttgttcatgaacactgtaagctggaggaaaagaaatcttaaagtctcactcttgaccacagtttctctcaatttgcaaatctggtaccttgaaaaatatccaaaaagacaagagagctgggcagaagattaagtcgtagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactttctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatgatgtccacaactgtaggtttacctaccaaaaaaaaagggcccaaaatagttctttttaaattgccaatttaagtctttataagcaatgatattcaaatactgtgaaactttgagtcttatcaaaaaaattaccaagtagtagaaaaaaattttaaaggaaaaaaggtaagagtattcaaaaaaaagttttattattttttttaaaacatctcggccaggtgtgctggctcatgcctgtaatcccagcactttgggaggctgaggcaggtggatcacttgaggtcaggagttggagaccagatggccaacatggtgaaaccctgtctctactaaaaatacaaaaattagccagggtggcaggtgcctgtaatcccagctactcgggaggctgaggcaggagaatcgcttgaacctgggaggcggaggttgcagtgagccaaaatcaggtcactgcactccagcctgggcgacagagtgagacaccatctcagcaacaacaacaacaaaatatcttacattttgttttcattactttcaaatccacacatcacatgtggtgaaacatgttcgaatgatgataatgaataaggaggtcacttacttacgttgttaagctgttaaatactatgtttagacatttatttcgagtgtatataataatgagccctactatggtagaatttctgtgtactgatcctagaagtctgactggatacaaaattcacacttttaaaagcaccctataactctaacactaccttgttgaaaacgacaaaatgtactatgtattaaaacccttccctctgaaaaaatgttcacattcctgaaattttatccctataggaaaaaaatgcaatttaaaaaaaaagaaaaaaggctgggcgtggtggcccttgcctgtaatcccagcactttgggaggccaaggcaggtggatcacttgaggtcaacgagttcgagaccagcctgtctgacatggagaaatcccatctctactaaaactacaaaaattagccaggcatgctgacagacacctgtaatcccagctacttggtaggctgaggcaggagaattgcttgaacctgggaggcagaggctgcagtgaaccgagatcgcgccactccgctccagcctgggtgacagagcgagactctgtctctaaataaataaataaataataaaaattaaagaaaaaatcacacacaaaggtaatcagtgtaatgtttatacataacaacaaaggattattagaaacaatctaaaaggttctaaaagttaaaaaaaggcattttacagaccatcaactcaatgaatattatacaaaatgtgttttaaaacccatttataacaatgatctataaaaacaatttttaggctgggcacggtggctcacgcctgcaatcccagcactttgggaggctgagacaggcggatcacaaggtcaggagatccagactatcctggctaacaccatgaaaccctgtctctactaaaaatacacaataattagccaggcgtagtggcgggcgcctgtagtcccagctactcggaaggctgaggcaggagaatggcgtgaacccgggaggcggagcttgcaatgagccaagattgcaccactatactccaggctgggcaacagagcaagactctctcaaaaaaaaaaaaaattttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaatgatactaaagaataatacatctttaacaatatattcacaaatccatatagaaaagatcttgaataggacatataagtatgtaactaaattgttgagcatattaataatgccaatagcatttccatttggcagaaaaagatgacaacacattaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactgctagacactgctggtaaagccggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcacaaaagctaccattgtctttccttaatttttataattttactatttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgcgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaatgaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatccgcacaaaaacatgtatacaaatgttcatagcagtattattcgtaatagctaaaaagtacaaataacccaaatgttcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttgtatgactccgttcatatgaaaggtccagaaaaggcaaacccatagacacggaaagtagattagtggttggcaggaagtgaagtgaaggtgggggggtgaggtagaggaatggggagtcaccactagtgggtacaaggttcctttatggggtgaaaagatgttctaaaattaacagtggtgatggatgcacaactctgtgaatgtactaaaaaccactgtaccacacactttaaacagtgaattgtatggtatgtgaattttatatatttatataaataaagattccttaaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaaaaaaacgaagaacagtggtaccacctagggctggagaagtgaacaggatcacaccagctcctagaatgtatattaagagcaatggtcgatccccctttgccctctggtgttgggaattttggccttgttctaaaccagtttcccttcacagaagttcagccatcgtgtgggatcagaataaggtcctggggcaactaaaggtatctggccaagggtacatccgaaggaccctacaccggcccccagtccccaacagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggacccccccggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggtaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtagcaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgacctggataggtatattgaagcctttcagaaccttaatcaaatgtctgagctttcatggaagggtatcatgttacttctcaactagactcttagagcttcagagaagcaggcggctttacaggtcactgagacatttggagatgaaatgtttatcttattatggcacctaccaaaagggggaagaaattagggagccctttctgacagccaagcaggcagcatccaccaataatcctcaatgggactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacacatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcgatcccagggagcttctcattctatgaccgactgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgaggggcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccaggacagactctttgcctccctctggtggagactgatattaatccaggtgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgtgacagtccttgtaatatcctaatattggaagtacagaaagaaacccaacagggaatggagactggtccaggatctccacctccttaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcccccacctgtttgggcaggcaatctcaaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctactttacatatacctgcccttccccagttggtcctctacactatcgtgcctatttctaaatggtgctttttcaagcatacccacagaccaatcagcatgcacttcccccatttcaagcccataaaaacctctagactcagcctcgtggctggcaacccaccttcgggtcccctctcgctgttgagagctttcttgtcactcattaaattctactctgccttactcagggaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaagtgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagggaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcatggataaaataattaacataaatattttaattactgcataaagttatccatttcactgcagctttaaaaataccatttttaaagagttctaagatgttatgtaaaataaattttaagtagatgcaaagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttagtatatgaaatctttcatataaacagttggaaagactactaaaatgaacatctatataccatgccttccatcaagaatcaataattgttaaaattttgccataggtgctttacctctgagacaatttaaatattaaaagccactctgctcactatgtccctcagtgagattagggctcagaataagcatggtatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactactacaacatacattatacatacattttgtataggtttcacaaaaccatatatactataatagagtttcagtgataatttcaactatgtaattgtcacctttagaacacattcaaatcagcattagggggacatgcactataaaattcattgtaatcaagattataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagtgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttgaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatgtgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaaccaagccgactctctctaggcattcaaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatacaccctccttaactggacacacataactgcttttctagctaactggaaagaaaaattttgctgtcttaaagattctctgggaacacaaccgcaacattaatttgggatcaggaaaattcaaagccaagagtctgttgcaacccatagaatttttttagaggaaatcttacacataattcacttcaactttgcacaagtaacaaaattataatgagaacaatattatatcccctgaatataagatgccactcataagatgtatcattatttcatgagaaactaagaaagaaaaagcactgccaattaaactatgacgcctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagaaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaaatactcatataagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaagtgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacattgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcatgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaaacccggtctctactaaaaatacaaaaattagctagccagacacagtggcgcacgcctgtagtcccagctactggggaggctgaggctggagaatcacttgaacgcgggaggcaaaggttgcagtgagccgagatcgtgccactgtactccagcctgggtgacagagtgagattctgtctcaaacaaacaaacaaacaaaacaaacaaacaaacaaaagtactacattgcctacttggaaatatttggaaatgacggggagagtttaaatttaggacaacagtcaaggggctggatacaaacagagaaatattctgaataaactataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggcaccaagtgccgccgactggggggagggggatggccacccgggcgaggaaaggaggcggagcgggccgtaccaagtacaccctcggggtggggggtgcgacccggcgagaacgggcggaggaacgcgacgggcgcccacacgcgccgccactctaatggtgtgcgccgtaccacacggaaggcgtgcgagggagagggcgagggtggagcgaggccccaattggcctgaggagctaaatagggaactttggagacagccccagcgctcggagagcgcaacaactacgcgctccataaacaaggaggcggaaaccggccctcaccactccgcccagaagcggggaatcccaaccaatgggcgcggggagtggtaagaagccaatccctggccgaggcgtaagccttcagccaatccgggctgaggggccaaaccaacgggctcgctgttggagggggtgacttggagagcgtaccgagaaacgagtagtttatggaaagccttgggggaaaactagacaaaaatacaaagggctgttttccataggacgtagccctgatcccaatttatttcgtctcctcatcgatcttaagggaaaggggtaccgtcattccgaacttttgggcgacggatccatctcccgggatgaaaaaccaagccaggccgcccgggggctggttctgcgtcggcggggggtccctaatgggaattaaaggcgggggtgattgggcccgggtgaggggagccgcttgctgctcgcgaaaggcccgcgccggctgtcagcgctgccccgggcttgcgacacccaggaggtcatgtccccatcccccgcggaccgtggccctttggccccttggcctggaacctctcctgacggtggcctcgccccagagccatgtgccgggcagcttagccgggtggaaagaacacgcgctggagagccgggcagcctggcccttgctccctaggaagccttatgctatcggatcggatcggctttaccccctcgggtaaatccttcccatcgcttgctatggcgtctgcagccttggcctagacctccttgatcagcatcggctgcactacctttgcatttcttcaggagcccagctagttcgtgcctcagggcctctgcacttgccctttccttggcccagaaaactcttcctcctacctttttcatcctgaagttcttctcagctcacttgtccccttacagagtcctcccctggctgaccacactaatgtacttcctccccaccgttaataccataacacattttattatttccacaccacttaaactctgaaatgatctgatgttttatttttctgtctgcaccacttacataaaaccatgacggcaggccccctgcttgtctaaattttttgcctagaacagcccctggcatgaggtggtaggcaattctttttcttaaattaacgtgataacgtttttgagccttaacttccgtataactgagaaataattggaattaatacttaactaaattgttagataaaggagaatatatgtaaatacccataataggctcatgataaccacatgataaaggtggtagtagtcattattagggcagccccaactggtattatttcagatctcccttctccccaccccatttttcttccctcttggcagatgtctctgattcttcactgagattaaaaaaaaaaaaaaaaatctagctccagcaacttctatcactcttttccaagtattgctgtgtaccacccattttgtgaacattctcatgtacccaaaggaccaggagtcccttctccctttccaagacagccgttggggcctgcgggctgcctctcacccctgtccagatcttccccctctttctctgcagtaggttcttcctttctactttcagcccaaatgggtttgacctacctgggggaggaaacttaatttaaccctcctcaagcactcatttctttcactgccaaactgcctagacaaatctatgtttattcctcccttttcttcaaggatctccttgataagctcagtcacccttttctcagtctttttttttcttctccttcaaagggttgttatagtatgaaatattccatttaaggcactcaacaaaatgcctggcacaaggtaagagccatgataatccactgatcacaaataatcaatgactcctcattacctacagcttcagatcctctctcaaggacatggtctgccctgtgtagcaacacagcacaaacccctatccaggcatgaagcactttctcaccctcagtgtgacttgagtacagcccattcatactttgccttcttctgggacacttttctttattctgtttttcgaatcctccctttcttcaagtaacacgacaagtcttactttaactagtgacaccttctagaacctaggcctgcactcttcaataccataatcaccagccacaagcaggttttttttttgtttgtgtttttttttttttgagatggagtcttactctgtcaccaaggctggagtgcagtggtgggatctcggctgactgcaacctctgcctcccgggttcaagtgattctcctacctcagcctcctgagcagctaggactacaggcacacaccaccacgcccagctaatttttgtatttttggtagagacagggtttcaccatattggcctggctggtctcaaactcctggcctcgtgatccacccgcctcagcctcccaaagtgctgggattataggcgtgagccaccgcacccgacccacgtgtagctatttaaattgaaatataagctagataatttaaaatttagttccccaattgtgctaaccacatatcaaataataaccacatgtagctggtggctactgtattaatcagcgcaaaataaatatttccatcactgtagaaaagttttgttggacagtgctgatctagaccatgaccacagtaaagttaccagccctacctttaactgctgtaagacctctgtgtaagtcatttcatgccttagtgcatactgcccccatatttttagttaacttttccaacatgtgcctttttgactcaactagactatcagttttcagatctgggctgacttctttttatctcccatgatttaatcagcatgaaaaaaagtgtttgttaaaggaaaaagaatacgcagattagaggagaagaggcttcagagttagctgggagagaaaaatagtacttgtaagggcagagatttatgttgcttcttcactttgtattggccctttctacacagtgcctaattgccttaagcctaaactgtgaattgtcaaagaagcacctctagaaacaacagggaaagaaatttagttttcagagcaactgcaaattagtttgtttttttttgttttttttttgagccagcctctcgatctgtcgcccaggctggagtgcagtggcgcgatctcggctcactgcaagctccgcctcctgggttcacgccattctcctgcctcagcctcccgagtagctgggactacaggcgcccgccaccacacccagctaatttttttttgtatttttactagagacggggtttcactgtgttagccaggatgatctcgatctcctgaccccgtgatccacgcgcctcggcctcccaaagtgctgggattacaggcgtgagccaccgcgcgccgcgcaaattagttttctataattgcattttcaccacacaataaggaagaacacacacacacacacacacacacaaaatcccactttagtatcaagtggactcctgcccccacatgctgttcagcctggagaagctttaattgatactcattctggactttgctcttgtcttcccctccactccagatttgactctgtaaaatgtaagtaaacatcaaaaaaagacgggaaaaagaaaaccttttgtctttcagccaaaatacatatttattgtaggaaaattagaaaatacaaacaagtaaacagaaataaaagtcccatgaaagcccaagacccagaaaaagaaaatcagttttaacattcggggtgaatttccacagatttttttcttttttgtgcatacacataaactcatatgcacatttttatgaaagaacgctctcattgtatttactattttgtaaacagcttttgttgtcctcttaacattcctccaacaacaaaaacagtttttagaactgcttttgacatctttttaaaatgcttaatagctgttacactagcttatagcttattcaacatatctcatacatattttcactttgaattattcttagaagactgaaaccagagagagacaagatagaaaaaggaaaaatttcatctcttaaatttgagaaattatatttttaaaaaccttctgcttttatgcaaaacacactttcagataagggtaagaaggactacatttataattctgttaataaaaatgaatcagcgaggttggcaaagaactaactaatttcctgactactctagctcacaactaatataaaagtaaaagtaaactgacaaaatgtgttattaaaagaaattctgaattgcaaaaaatagcatttcttctcatttaaacaaatcaatttttatcttgttttgttttgttttgtgttttaagagttagtgtctcgctgtgtcacccaggccagactgcagtggtgcaattatggctcactgtagtctcaaactcctgggctcaagcgattttcctgcttcagcctcccaagtagttgagattacaggcatgagttacccactgcgcctggcacatttttatcattttcaagtaaaatatatatatctatctgagacatttctgggaattgctgctatgaccagttgaagaaatgggtgaaagcacaactattagcaaaaagtcttaatctgaatattttctacatcttttatgtcacctgtgtggtttggggcccgtttgctggctggattaatgatacttgctcgccattatgactgactcttagggattggatatgcagtattgacagtattgcacttctgtgtccaccatctccgtctttcagctccactgtttgtagaagatagcctctgctcagcggcatagccctcctcactgtggccttcaccactcatgaagtccagggcagttctagtctggttgactaccagttaagttaccccctaatagacttccatgaggacctcattgacttccttgagtatagtttgtaggcactgccctcgtacctgggtgcttagcctatagggggttatttataacttttgaaacctgctctctcaggttttattgtctgagtcttttcctttctggaatctggatgtttttcttaggtttgtttcctgctcactgttggtgtgctttaccagctgtagcaggaagagtgctagcactgtaatcttgtaattcattcaacccctctcagcctcagatgctttatctataaaatgagaagcttggaatagatgacctttaagttccttccagttctaaaattacagagatgccagggcttattaagtaacatgtgaggtgcaacacaaccaaacaggaatagacagaggcatctttcctgttttcgaaagcttggagtctgaatcattacttcctcattatggaaacgtgatgaggtttgtttttttgttttggtttggatttttgatttttgattttggttttaataaatagctacaatttattgagtgcttataacacgctaggcattctgctttaaatgtgggattatctcagtcctcaaagcaaccttttaaagtaaataatgccgggtgtggtggctcatgcctgtaatctcagcactctgggaggccgaggctggcagatcacctgaggttgggagtttgagaccagcttgaccaacgtggagaaaccctgtctctactaaaaatacaaaattagccaggcatggtggcgcatgcctgtaatcccagctactcgggagcctggggcgggagaattgcttgaaccccggaggcagaggttgcggtgagccgaaatcgtgccatttcactctaggttggacaacgagagcaaaactctgtctcaaaataaataaataaataaataaataaataaataataaaatttaaaaataaatagtatttggattattatccctgtgttaacagatgaagaaattgaggcacagaggggattagtaatttatccaagattacacagctgataaagtggtagagctggaatttgaattcaaatctttctgactctataacttgtaagtcattgtacttcaaaaggcgaaattatgctccatgattacttgttaagcatgctatgtccagtagaataaaggaagctttaaccaaacttcattgttttgttttgttttgttttcaataacaaagtctactccacctaccttgcaacattgttgagagaatatatattaatgttgcaaggtaggtgaagtaaacattgttaaatatgtatttttaaattacacatatatttaaaaatatacacatatttttatatatatgatttttttaagtgctcataaaccatgaagccccacagaagtgcagggtgctattatttcctcttatgatttcactttctgtctttcatttcttagcatatgaattgtacttcttttttcaactttttttagtagttgccctaaagttgcaatatacatttacaactaatccaagtccactttcaaatagcactgtaccacttcatgggtagtgcaaatactttataataatgaaatatccctaattattccctccagtataactgctgtcattctttgcatttatatataaactataatcattcaatacatcattgctatcattttgaataaactatcatctgttagatcaacaagaaaaagttaagttttttactttattttcaactattctttctctattgctcttcctttctccatgtagatcagaatttctgacctacatcattttccttctctctgaagaacttcttttaacatttcttgcaaggcaggtctactggcaacaaattccctcaattttcatttgtctgagagagtgcttatttctccttcgtttttgaaggataattccacaggatacagaattctacgttggagggttttttctcaacagttgaaatacttcattctactcccttcttgcttgcatagtttctgagaagtcctgatataattcttacctttgttcttctataggtaaggtacttttctcctctggctcttccaagaattttttctttatcattgaatgctctggcatatttcaaaataactttttcctttctccttccagaagcatggattttttttctctgatattcactgtgagaacctaccaaagctctaagaggtaaaacccacacaagtgtgagaagcttccatgacagcctcgccccactgccccatcctagggtttttaactctcagacttgtccactgtgagtctcagcatttcttcaattacagtttaggttttcctcatgagtactgcttcactcagagatttctgtttctgagatgatgctccagcatgttgcaattctctgtatctgcttatctgaccccccagcttaggaggcagcagtttgccctgtgacctcacttctgtgaagaatctaagaatactggcctcagcaatatggtggaaaacacctctacaaaaaatgagccaggcaaggtgatgtgcgcctatagtcccagctatgcaggaggctgaggcaggaggataacttgagcccaggaggtcgaggctgtagtaagccatgattgtgcccccgcactcagcttaggcaaaaagacaccctgtctcaaaacaaaatctaagaagagtttgttcagtttttgcttgtggttagaatggagtgatgacttccaaactccttacataaactggaaactggaagtcttcctatgtatttgattcaacctgtttatatatcttatgcatctgtgcagggtaaggtttgggttgtaaattgataaagtacacgattcatggcttttgacaacctggaggagactctaggcggtaaactaaagcaagtgtttaaaaatggccttttgaggccaggcactgtggctcacacctgtaatcccagcagtttgggaggccaaggtgggcagattgcttgaaccgaggagttcaagaccagcctgggcaccacggcgaaacgccatctctacaaaaaatataaaaaattagcagggcatggtggcatgtgcctgtagtcccagctacttgggaggctgaggtagaaggatagcttgagcccaggaggtagaggttgcagtcagcctaaatcacaacactgcattccagcctaggcaacagagccacaccctgtttcaaaaaataaaataaaataaaaatggccttttgagacttctggttccaccaagatagagtagtcccatttttcctaggccctctcagaaaaacctggatataacacaaaaaacaagcataggaagactttgaaagttggaaagaagtcagactgcctagggatcccaagacttgaggaatgacatgtggtaaattccctagtttcctcatttcctcctaaatgtcggacaaggcactacagaattctgcagccctgcaccatgaataggcacagacaaaacaaagacccatggaaagcctgttttcctgagtcaaagaatagaaaaaagtgtggcccaacaatgaaaaacctcatcagcttcttccctagtccaaccaaacactgatggaacaactgcattccccaaacctcaacccccagcacagtttcagcagagccaaccaggaagttgatattccactctaccccttaacctatggaagtgggaggcagctctccagttccctgtgggtgactttggtaggtctgactgggagctgaccttttattccctaccttatagaagcagacaatgctccagttcccccagcagattgagcaaggagacaagcttacatccccaatcagaggcatcaaggtggtcgaagttggtgccacactttcactgggatgttgtcagtggagcaataggagagctgaacttccagcccaccatttgcaataagaccatgtgagtcagtacttcagttttgccaagttactgtcagtggggcccagagggaaactaaacatgcctgtgaagaagaagaaggaagaaggaagaagaagaagaagaattattaaataggatacaaatccaaactcttataatatgctatccaaaatatccaggatacaataaaaaatcattcatccaagaaccagaaaaatcacaacacggatgagaaaagcaatcaacggctgtcaaatgatgagataaatcaagtgttcaaattatctaacaatgatattaaaatagcatcataaaatgcttcaacaatcattcaaattctcttgaaacaaaaatttaaaacccagcaaaaaaaaagagaatttattaaagaattaaatgaaaattatagaacagaaaacaagtacaagtaaaattttaaaacttgctgtatgggctcgatagtagattgaagataccataggatagaatcagtgattgaggacagacagatagaacttacccaatctgaacaatagagataggggaaataatgaacagggtctcaaggatctgcatgatatttaaaaggaaaaaaaaattcaaagaatagctgaaaattccccttacttggcaaaagagatgaaacttcagattcaggaaactgaacaaatcccaagtaggataaactgaaagaaatctatgatgctaagacatgtgataattaagcttctgaaggttgaagataaagaaaaaatattgatactgaaaacagccagagagaaatggtgcattattgataggggagaaccaattcaagtgacagcagatttttaacctgaaaccatggagaccagagggaaatggcataacattcttcaagtactgaactaaaagaattgtctacctagaatccaatgtccagtgaaaatgtccttcagtaatgaaagggaaatggagacatctcagatgaaggaaaggtaagagaatttgtcaccagcagacctaccaaaaagaatggctaaagaaatttcctaaacagaaaggaaattataaaagaaggaaacttggaacacgaaggaaaaccacagcaaaaaaatatgggtatatacaataaactttcctcctcttgagtttttaaaatttctaaattgatagtggaagcaaaaattatagcattgtttgatgtagttctaaatgcatgtagagaaaatatttaagactattataaacagggtgataatgtaaagggaggtaaggtttctatatttaaactggtaaaaagatgacaccagtagactctgatgaatatatataatgtaaaacctagagcaaccactaaaaagatatacaaaggggtgcaataaaaacgttgtagataaaggggaaggggtgttattgtttaatgggtagagagtttctgtttggggtgatgaaaagattctggagatgaatagtggtgattgaacaaataacccacaggctcgcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgtaaaaagatatacaaacataatcaaaagaaaacataaatggctatattaataccacctaaagaagacttcagagcaaagaaaattaccagtgacagaattggacattatatagtgataagagggtcaagaagacatggcaattcaaaatatataagcactagacaacagaacagcaagatatgtgaaataaaaaactgatagaactggaaggagaaatagatcaattcaaaataatagttggagacttcaacacccatctatcaatgattgatagaacaactagacaaaatcagcagggatttgaaaaaactcagcatcaccaccaacagacatgatttaatcaacattatagaatactccacccaataacaccaagaatacacattctttttcagtgcccatgaaacatataccaacatagatcatatcctgagccatagaacaaaactcaacaaattataaaaaattgaaatttgttcaatttgttcaattgaaattgaagttatgttctgtgagcacaatggaattgaaccagaaatacataatacaaaagtattatggggctcaggacagttcagaaggagaggagccctgggagaaggctgagctcagatggttggggcagttgggggaaagaagtgagctggctctggagggccaggctactccatatggcaccctgctgggcagaggcagctccatgccagggcacaggacttggtgaggggaacaggagctggacctcagtcccattggccccctggctgggtgccctcttacaggggcccaactgtacatggtgaccctggatgttggcctgggaacctgtgatcttctactacatctggggctgacagaggactcgggggctgagaaggagacatggtctcacgatttggagtagagagaaggcttgaccagaagggactggctgtgcagcaggatagctggaggcctattggctgggcatcctgtctactgggtcctgggccggtcttggcagcaaagtcagggcagatagcaccagcaagccacaaccgtcctgctccacagagcgctagaacagccactcatcagttacagcaggactataacgatgaccaagaagagaagacaaaacagaagagggtaggtagaccagaaagagtgttcagaaagaagcttgaaagaggagaggagagacactcctgagtagtagcaccaacctaccagctagatttgtaacctccaactactactttctggcctcagttttgtcacctgactaagagggttggaataaaacgaatttaagtctcttttacctttgactaggactgacccaggctggcctttcaccagctcctgtccccatttccaagggaagctgggtggggggtagagggtgtggatgacttagtgtggtccatcctcagaccaaaaacccagctaggggcccacacattactgtctgaaacaccatgctcaggtgtgaacaaagatgcttggttactgtggacttttagttccaaggagggctgtgtctttcttaactcaatggaagaatcaaattaggagcctggctgggcatggtgactcacacctgtaatccagcactttgggaggctgagacaagaggatcacttgaaatcaggagttcaagaccagcctgggcaacacagcgagaccccatctcttaaaaaaaaaataggagcccacatcttcagattcccagggctgagattctgggaaactcagccaaactccagagctgatgcaagtagcaaaggaccttttttttggtcactggagcctggaggacagacaagggcaagaggcagagaattccagcctttacaggtcacagagaaagtggaggaggaggaggtagctgatgcctccacacccaggagggagggggaaatgatgagcaagatttttcaccctttcagtaaaacaaaaaaaattatttctcctatttccttctctgagattaatgataaactgtctatcccctaaaagaaaatgataaagactctaattttacttggaggcttagaaatgccatttctacgcaaaacagggagcccataatcagacttgagcggggcagagctttgatagaaaatgttttcctctctccctctatttcttcccctccttccccttgcaaaccaagatgcccgacagctaagaacaatgctcaataaaatgaaataatattttagtcaaaataggccaagactgctcccagccaactgtaaattagcattttgagggcaaatatgcagacaatttgagataatgaagcctgattattcaatccaatgaatgttaactagggagcagaggctccactgccttatctcactcccttcgatttatttttttaatcgtttcacatttgaactctttatttgtttctgttttatgcgccccctcccttcctctgtcacacacacacacacacacacacacacacacacacacacacacacacacacacacagagtctccctcccttctctcctccattcctgcccaggctgcagaaggggaccgttgcaggggccatcagtctttccacccagcctggccttcgggatggggtcagcacgcctcatggagcccctactgtgtgcatggtcctttgtagagttgcagggatttgggggtcaatgtgcactaaacagatgacacacaccctgcttcttagaacaggcctgggtgcaggagctggagaatggcaggtttataaaggaacatgccaggtacatgtggggctcagggaagtgggggtggaaggacattgcctttcatgtccttcaatccaccctccatgaaaggtcaatgtggagcacgccctgtccccaggagtcatggaaaactttcttaaattatcctttgtcccaggcaggactcactgcataatttgcaggacccagtggaaaatgaaatgcaggggaacttgcccaaaaatcattgagaatttcaagatagtcatggcagagcattaggacaccaagcaggggaccttctgagctcggggcctgggcaactgcgcacgccacacacccatgcagctggcctgcctccagcagctaaggggcagcctcaggccagtgggaggtaacataatgaggccttctgaaggagggttgaagcccttctcaagtgaagagagaggtttctgagacgctggggagggtcccagctgactggggctagcccctggggttgcgggttgccataggcaggagccccaatgcctgaacagctgtcagcatggtggtttccccttggaggtacccatccttcagcctagagatgatgtttacttggtggcggaaagaacagctcccaactgggcgaggctccccgctgttacggtgctcacctggcctcaacctcctccttgggtcctggccctgctttttccctcacgagtgtggcctcccagtccctgccctgtccccatgagctcctgcctgggtccagcccctgcagctgcccttccctcggggcccccttaccactcctttcagtgtgtgtagcaggaagtccccgcctgagcatggcctcccaccttgtctgctctgctcctcagcttgccctctccccaccagacctcctgcttgtcgagtgccctgtccatcactctcatcttcccgctgcctctgctcatgctgggccctcacctggggggtcttcagcccccttccacctcctatctcctctccacccatttcttcacacccagccaaagaaggcagctctgccttttaccggatgtgctcttgagtgggtgatttcacctccttgagctttagtttccctgtgggtaaatgggattgtagtggggcctgtctcgtgaggtgagtgagaagaccaaccaagctggtgtaagtaaagccccgaccccgggctggcccacctgaatgtgcatacctgttagcttgcactctggggagcctctgggaagcttcagaatgctacagccagttggaacagctgccctcctagaacttccgtagcctttggaatcctggtcacgcagtgtagcctgcattcttacactgtttcctccacctgatagaagtttcccaagagtagtgtggtgagcacttaggacgtgctccctcagcctcctgtgccaccctccttttgtctggagaggctggaaaattaagagctgcatctcccagattcccttgcagctaggcttctggaagtgaattgggtgatactgatcagttagactcctgaaactcagaaggtggacatgagactctttcctgccctgggtttctaatggctatcaagatagtagaaacacaattgcctttttctgcaccagattcccattgtccatcctctagcttctgggtgtcaagagtcaaaaactgttgttttggtttcagtaatggcttgattctggtccttcctacccttccttccttctttccttccttccttccttctttcctccctctctccctccctttctttctctttctttcttcctttcctttctttctctctccctctttctctttctttctttccccttccttccttctttccttcctttccttcctgtcccttccttcccttcccttttcttccctcccctcccttccccttccttccttccttctttccttccttccttttccttccttccttccttttccttttcctttcttcttttcttttttctttcaagatagagtctcgctctgttgcccaggctggagtgcagtggtgcaatcatgactcactgcagcctcaacctcctgggttcaagcgatcctcccacctcagcttcctaagtagctgggactataggtgccaccacgcccagctaatttttacgttttttgtagagagggggtctcagccttctgcttcagattactagtataagccactgtgtccagctgattctgggtttcttgatctctgtattgcagctacagtggtttcaaactcaattcaaggggtggtctcagaggttgtagtgccactgggagttagttcagaattctggaattccttcctggatgttcaggttagaacctaccattctggcttttccaaaaattttgaaagtatctaattctctgttaagtctctctttggtgggtcagtgcagtggatcatgcctggaatcccagtattttgggaggctgaggtaggaggatcacttgagcccagaagtttgagaccagcctgggcaatataggaagacctcccatttctacaaaaaataagtttaaaaaattagctggggccaggcatggtggctcatgcctgtaatcccagcactttgggaggcccaggtgggcagattgccaggtcaagagattgagaccatcctggccaacatggtgaaaccccgtctctactaaaaatacaaaaattagctgggtatggtggcacctgcctgtagtcccagctactcgggaggccgaggcaggagaatcatttgagccctggaggcggaggttgcagtgagccaagatcgagccattgtattccagcctggtgacagagcgagactctgtctcaaaaaaaaaaaaaaaaaaaaaaaaattagctgggtgtggtggtgtgtgcctgtagtctcagcttcttgggaggctgaggtgggaggatagcttgagcccaggagattgaggctgcagtgagctatgattgtgccactgcactctagcctgtctcaaaaaaaaaaaaaaaaaaaacaaattagctgggtttggtggtgtgtgcctgtagtcccagcttcttgggaggctgaggtgggaggatggcttgagtgcaggagattgaggctgcagtgagctgtgatcatgccactgcactctagcctgtctcaaaaaaaaaaaaaatctctctttggttaaaaatgcccagatgggctttctacattaaatcctgacaggcacaagaataaactaagccatctctttctcctgcacccccactgcacagcacctagtgtaggtctccctcttcctaagaaagccgcatgtcccataccagctgacccggcaccatggctggcctctgagctgcccgagcacatgctggacatttgcctctttgtgcatcgttcatttcctgccgttgccctgctctgtcctgtaagcaggaagctgactcctgcaaattacatttcccttgtccacatgcacagtgccttgtccactggtttcttgttgggttcaaccaatgcaaagcactggtgagaaaccggagggtgagagacggggaaggccagagtatttcctgtcctctctctgcttccagtggcatctattttgtggagccagcttctgccaggcaacacctgcaccacggcctcccagctcccagccattggcccctccacagttaaagctctgccctggcaccccagctcctggagtcatgtaaatactatctccctgctctgactgtctagatctatgggtagtagcagcttcctgaaattgctaatcttcgagttgcctcaccctcccctgttttcagcttttccaacactgtcgtaactgggttctcaaatgaaatcacctctctagtgagctacctggtgagctgggttttcctgacagtgtggttcctcctatctgctacaagtggggttcggggccttgagccacgtcttccctccttgtggacacagtctgtctcccctgcggcctccctggccattttgtcctggcccagcctgaagaaacatctgggcaaaatccttcggggtccctttccccagctgaggagtgggggggcgcaggggaggagccagggcgaacggcagctttcgccaacacctcactgttctcttctcgacatgtttactcacaggctgtctgggaagtgagaatcctccctaatggatgtttcacccaattaaataattaactccaagtgttgctaagcatcctcgcctctcaccttccagtcctggaggcgtcctcatgccaggctgcggctgctgctgagacaaggagcctagtgggaggagccaggagtgggggacagtgcccctgatgcttctgtacaggatgagggagataaatgcacctgagagggaaggtaaggagggctgttcagataggaggctgaggggaggctgagactcacaggaagtggcattagaaccttctggagcctttctattgaatattaagtccttgaaggtttccctctcccccaattcttcccatacgccacagcagggtccttgttccttcaaagaaggggaaaggaagggacacaggcttcttcctaatgggtagtcttgcgttatgaggagttacagagctgagctgctctactaaccagacagtcacataaggaaccccgaggggagaggctaaatacattcatactgtggaatatcactcaaccgttaaaaagaacaagatacattttcctgtatagataggaaaagatctgtaagatactataaagtgaaaaaatgcagataccagtacatgcagtttaatttaagtaaaaataatgtgcacatgtatgcatatacttgtctacctgtggaaggaggactggaactagggacaccaaactattccgaggggtgatatatagaacaaagctcctttcatgaaaaattgaactcacatttctgcagtgtaatcacacattctatctggatttattgtttaattgttttctattgtcaaacatgtctaagttattgacattagaacagagaaactccaacagagaaagggagcacagctacattttttttcttaaagattatatactatttctttacatggatgtcttgattgatttagttattgattcatattacaatggaaggctgaatcaacttatacggctttgaattaattgtataccttctattgatgagtgaataaatagttttttaacattcaccacaaaacatataaacattaacaattttgtgatattttacataaaacgtgcaagaaattctaaatttgaaattagtatttattttatagaacatattatgaaatactttttaaattagtaatcagaaaaaagatgattaaatagtaaaaacaatcatttgtatttttaccagatatcatcacttttaaaagtttggtttatattcttccagatagaacaatatactaaaataatataaataggttattatgtcaacaaacatttatatatatttttacagctggttacccccatgcaaaaacgtgccatatgtaatttttctatctaatatatttgaaaatgtatgttatttaaaagttttcctattgtaaacaatactataatgaatattattaaagacagtcttaagttagcaaagactgaaaggacatgttctctagtttagagtgtatgacattcaatcaagacctagaagacttatgccatcccccaagaatgtactaaaaatcatctgggattatagaaggaattcagggaaccctatctgcaagattatttacatgccagatccagtaatttatgatcttcttggtgtctgtaaagtcataaaagtcacaggattacaccatagtcatttgcttgaaattgcattcaagatatctgcattccattccttagatgctttccaaaataataaaatacctggcaggattctgtgtggaatctcagtcttcctatgtgggatgatcacatgtagcatccttagtgccaaacctaataaaacaagcttattgtttttggttttggcttttttttttttttttttttttttggagcatggttgaaaaaacttatgatacccagaacaggtttaataaatttttctaaactggatattgattatcaaagccaattatatgcctctaatatattgatttggagaatttagaaaatcaaatatttcaaatatatcagaaatctacatactaataaatttaaatgaaaaaatttctattaactaatgtatgtcagcagcttttattgacaaactcattttatttttccaaaggcatacaaagtagtttctataataaacctggcaaaaatagatatctagctagcattagcccaataatacaaataaaatcaaatcttgaaagaaatggaactttttaccattccagatagtataataaatgtaatagtataataaattcgcatagctctataacgcagatttggctaaatatgactctataaaatgacatttaaaagaacagtgttgtatacagcatatggatgacatagtttcttacaattttatagtaaaataataattacctgaataaggtaacatcaatcacattcatttaaaatagttgatttataaactagcttgattttaaaacaaataaaagaaactatctactaaggtaacaatgagtatcaattagagtgtcacttcacaaactttaatgttcatacatatgatggcatcttgttaaaacagagcctctgtttcagtagttctgcaccgacctgagaagctatgcttctcacaaacttcaagatgagattgatgttgttcttctatgaactatactttgagtaacaccagattatgagattattaataattcaaaaaataagcttattttttaggaaaaagtataaaaaaatcaggcattcaaactccacaaaaatactttttaagccatattacaaatagaagctttaaaatacatttcttttctctgcatggtttatgaatcttcatttataggactggctaacattgacacaaagttcacagtgggtattatatccatatatctacataagatgttcagcttctctcattctcagcaggtatggtctcattaacacctgtgattttaaaagcctgagtttctcccagcaagatgtagttttattaatatgtgttatatttatatatctctcactttgctatgttataatgtggaaccaaacctatagctattgctctagtatctgtttacttcataaatattgactgctagaggtgtgaatcctactagggtcttttgcataattatatgagggtaagcagtaaacaaaaatgactgaagaataaatgaaaataataacttagcttaaatgtaaagtaagatgacaagaataccatgaaataagagtcacagaaagaatgtttgctgctgttatttaaatataaatgttattatttttgaagaaataaatgtgtatacatctatctctttcagaagaattgtgaattgtttacaaatatattttctgaaatatcttttttttcttagtactgaggtctgatggtaaatgtttagtaactagctttgtataataaaaagccagatttatggtgttttcagattttcatggtgtaaaaattcccagtggccaatttcaaactactgacatgagatctcggaacatagcattaggaaaagatgcagaaatgggcttttttagaagccagtgcataatacttccaacacaacagtgacttagcagactgagcgtcactttactttaatgattaatcacaataattgtcaactgacattttttatttaatgacttataacatggttccaattataaaatgtggaaaatataagtaaaataaagacaaaattaacaataaatctaacacccccaaaatgattgttacacatatgtatatatcctttgagagcttttattaaaatatttatacttgtatttgttacaaaattgaaaatgtgttttatttcactttggcattctacccaaactgacaatatactataattttctacaattattacttattcctttaaaagtacatacaaaactgaatgaaactctatgctcccaatatactaaaatcaaatgattttattctctatagtttatagtttatattctataaaatctatagaatgattttattctctaaatatacatatttagaatgttttgaaaattattggtcaatgaacattctgacgcagaaatccttgtaaatattacctctgcttctttagggtaaatacctaaaagaggaattattgagccaaaaagtgcaattactttgagggtttctgataagtgtccctaaattgcactcaggaaaatttgtgtaagtttaaactcttaagtggagttgctggagaccctctttcacctgattcataaaacaatcttaattagaaagaagaaacaatccaaatgtctttgaggttcaagtacaccacatactatcgcatttaatttttatagtctttaattttattagttcaatttttcatatttgaattgcctgttagcattctttttcttttaatttatgtaggactatttacataataatgccatcaatcatttttatatgtgtgtcaagtttatcttctattgaataatttatcttcataattttgttcataatatttattgaaattagaatgcataaatattaaacttaaaattatgttatatagtataccatgcatgattataaatattatgtcaaatgtataaagtggtttttgctgtcagtttctgatttctccacccgatataattattttatattacctctaatacaacagattcaattctggataatttggggaacaacataagaacagtagtaatcaaaactaaataaaataactacatgcagtttacaaaaaaagttcacatcctatgaatatatttaaattatacttcacttaaatgtatcatttcactatgcattttctattgatttcataatcatattcctttattccatttttccccctctgctggcagaaagtttctattttctgttggcatttagagtatcctaacatttacaacatgcattcatgatgtattaaactataacatgaattaatatttgcctcaatttacagcaaaatgaagaccttctaaaattgtaactccatttatttttcccttccaacttccatgctatttttataatacattttagtatatgctatgactcccaaaaacattgttattgctattattatgctacattgtaaatattcatttaaatttacccactggaatacaactttgtgtttcttattacttcctgaatctataaactaccacttaataccatttcatttttgtttcaaaggtaaccatgagtgtgggttctgtcttagtgaattacttcagttttcagtgatctaaaaaggtttttgtattatcttcacttgtgaagttttaactgtatatgggattgaagattagaaattattttctttaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgatagagcgagactccgtctcaaaaaaaaaaaaaaaaaaaaaaaaaaaaaaaaaaaaaaagaaattattttctttcagtgcatagaggttataattctattgtcttttcacttacattgtttcatttagcaagttaagagtctaaaggtgttcttttaaaggaaacgtgtttttcccctgactgtccatgatatttttctcttttactctatgtttctgcaattcctctctgtgtcatcaggttttgaattgctttctgtgtttttctgctttggattcatgtttccctttcaattaatagtttaattcatttagaagcatatcttccttgttcttgctctactttcttgagcccgtaattatatgtaagacttttcattaacctttgcactctacaatattttctatccttttctttactatgtttgattctacatattttattctaacatacctgctagatcattaatttccttatcaactgctctcaaacctatcttttgtgttttttatattgtttccttttcacatctgaaatgccaattttaagcattccaattatttaataaaatgtttatattttgttttttatcttcagaataattctactacctgggataattctactagtgatgcacaatttttgttccttagctcagctagttcagattcttgtctcacaaccaggaagaattagacaagtggacatcaaagagtgagtggagtagaatttattaagtgaaaggaaagctctcaggaaaaaagagaggatgtgggggttggttctcctacccaaagacaggaaagttccccaatatggctgagcccagggttttttgtgggctgaatagggagtgtgtgctgattggtttgtgagtatgcagaaaaggttaaagcaaagacaccactcaaaggtgggcatgacaacatagaaaaccaattaggcggctgggtgcagtggctcatgcctgtaatcccagcattttgagaggccaaggatagtgggtcacctgaggtcaggagttcgaggccaccctggcaaacacggtgaaacttcatctctactaaaaatacaaaaaattagctaggcatgttggcacgtgcctgtaatcccagctactcggaaggctgaggcatgagaaacgcttgtacccgggaagtggaggttgcagtgagccgaggtcccaccaccgcactccaacctgggccacacagcgagtcactatctgaaaagaaaaaaaaaaaataggtaaaataggtgaaaaagggggatcaatcagaggaaagcacacaaaacaggaaggtgggtcctcaatccaatccaaagatttacccagcacagtttccagcttgaatgttggatttcacggggaactcatccctatctgccttgggatttgtctgcctcctgtctctatcaatcactagctggccttttctgttattttgctctttttccttgttttctttcattttgttttgcctccttctgtgctaggttatcttttattttatgctggatttatatttgaaaaatttattttgttcacttgcaatactcattacagatacaaagaatggcattgttttatatttttataatttatttaatgcctgacttaatataagacatgctgatttattagatctacttctgctttcggtatgttgtgatatcatacattatgtagtctctggaaaactctacttactttacacatgagagagaaagagagagagaatgaaaaaatcaaataagatcttaatattgttatattatctcaggacctcatccctttgcctcttgagagtgggatgttaatggcttcacattgctcctgattcactattttttgtttgtgccattaagtttgtcaaaactattgaaaacagtagagacctcacttatacagccattgacatttattcctctttttgtaacattatgaatgctaatctcaaaagcacaaagtttgaaaaatcgttgcttttatctttaaattacctgggtcttcaatctttcatccctttggacaagtggaaaattccatacttgtagtttttgctggtaaagtatctgaaactaccctgtggtaggcaccctctgagataaaccctaataattcccgcctcctagtattcacagccttaggtcatcccatctttaccttaagtgtgacgtagactggcttcaaaataattctgagaaactatttcactttcaaaattataggctatgaaaagactgtgatttacatcttgggtactctctctcagatggtctcttgaatggctcactctgtggatagccagctttcatgatgtgaggcagtctcagatggtctcttgaatggctcactctgcagatagccagctttcatgatgtgaggcagagtcttgtggagtaatccacagggtggtggtgttgaggtccaccaaaaagcacatgagtgagtttagaagaaggtccctccaccacctcctttgaaatgaatcttcagataagatcacaaccccaactggcaactgcacagcaaattcaggagagcctttgagccaaaggtgcccaaaagccatgcctgaattcctgatcctcagaaattgagataataaatgcttgtttctttaagatacaaagacttgtgctaataagctatgcagtagtagatagttaacacagtcttctctttcctggtttatcacatttgtgccaaatattctctttgctcaaactcaagcccctacttctaaaaatacaaaacattgcatctcttctctgaatctttcttgaggcaggttcttaaatttctatacctccatatgcacacaaaacacatattcctcctgacatctttctatctttcagaaccgttgctggtgaaaagagtgaaggtcctctgcgtacttttttcctgaattctcatggacctctctgccttttccaaataagggcaatctcctttccttgagtcattgttttcccacaaatcttctacttgactgaagtgttcagggcacataggatgacttcaatatgcctgaatttacaaaagacctttatcttgttttttatttttgattctattacagtatctgaggaaaggagtcaagagattgcctttctgtgttatatgaattgagagaaagttctgttacacacacataaattaataatttaatttttcacctcaaatcttttcttaaaaccaactaactataattttctaattacagaacaacttcttacatcagaaaatggctctacatttctactcagaactctctcagtttaggactaatcttactaactcattaaaagcttactaattcattattaaaatgctctggtttccctttttataagttgttcattacagtccatgtccaaatggaatggacctttctttgtaattctttacacactgtcttaggccagttgggctgctataacaaaaatggcatatactggatggtttataagaaacacatatttatttctcacagttctgaaggatgagaagtcaaagactgaggcactggcagattcagtgtctgggagcacccatttctcatagatgacatcttcttactgcacacttacatggtgaaagggtctagttaattctctgtgttctcttttataggggcactaatcacagtcatgaggatttgacccttatgacctaatatccacccaaagtcttcacctcctattatcatcacactgggggttcaaatttcagaatatgaatttggtggcgggggcacaaatgtgttatgggggacagaccataacacatatatctgtaattgttttattttttcagaaagtgatcgtattatttctgtgacatgttatgccagaaaataatactacctttacgcttgaatcacaatgtagctatcaaatataccttttcctataaaactccattacatagcatttaatatttaaaagtgatatttgaggcaaattattgcctcacagcttaatcctttcattccacattcaaagcatctcccatgattgtcctcatacaacaacaatctgtctgtgcacaagtggattaattcttatctattttatactttaaacacttacacttctaagtgttctctacatacttccgattagactgcaattacttctgcaccaacctaatacaaaataacttgtttttttttaattttgatcccacaggccttaatttgtatcaatcacttttaataaaagtgaggttaagtaatattttttgagtctctacaatttatttagtggcatatacactgcagatctcattctcttatctttcacattagtgatgcagttatatattagaacaggaccttattaagataataatgaagatatttttcactgctccagtggtcacgattggattttcatcattcagatacctaagaacagtggtccacagcctttttggcaccagggaccagctttgtggaagacaatttttccacagatggggcacggagtacagtttggggatgaaactgttccacctcagatcaacaggaattatattctcataaggagcacccaacctagatacctcacatgcatggttcacaatagggttcatgctcctgtgagactctgatgccaccactgatctaagaggagacagagctcaggcagtaatgcttgctccccactgctcacctccggctttgcggccccattcctaacaggccatggactggtacaggtccctggcccaggggttggggaccgctgcctaagaacataaatatggaaatatttttgctcaaatgcacctaaccttcagatggctaaaaaccttttagcacccggggtgtaggattgagagtggagattactggctgagagaaacagcaaaaaacattcctcccattgaaattaaatcactctacaattgggtttaattgctggacctacctggtaactaacaaaaatactaaacataattgattgcctcatcatttgaaaacaagaggtcactgaatcaaataaatggtaggaaaatttagaaccaataaaacaaaacattttggataaaagttatttctctcttagacctgttgccatgagagtcccataaatgaaccagatttatagttagcagactttctcagtcacttataaataatgaccactgacacataaaatgcattcacaagtagatgcttagattaccacaaaggccttaagacctaaaacatcaataatgtaatgagctttgttttttgctacagacaaacaaaaaatacaccctgcaattttataaaaaattcaggattaaagatttatgtacgcttatgactcaaatgtaaccattattgtaagaatgcatggtaagcatgacattgtttcactagtcttgctacatcttaaaattaattcgttcattcatctgtccatccagaaaggatgttactatgatatacagcttctaaatggcccccaaccaatccccaaatcttgtcattgtggaatcccttcctcttgagcatggactagaccatgtaactcacttcaaatgaatgcaatatgaaaaaagagatgttacttccaagactgattataaagggattgtgactttttctctactaggccctattttactctctctcttttttctttttctctccctttctctctttctgtctgtctctctctctgttcatctgtctctcactctttctctctgtcaaaaccctgattctaaggaaaacaggaaggtatgttttagtgaattctcataattttattttggcccagcatccattttgaatataaatctaactttctcatactagaagcaggactcagtcacacttgacagtttccagttctttaaccacatccaccctcagttcccaaatgtgattggtccacatatttgcctgatacaactgctccctggtgaccacttctacttccctatgggacagctagacatagcctacctgactgaccccactgaccctcagacctcacatggactgtacagatatgtcacagtgactacctgtcagtcacagcactacgtcctggaactctaaaacttatgtttgcttgctttaaacccaccacttagaactccctgtgggtaacctatttagataaggtcctggatccaataaaggcattggctgatagggttctctctctctctctctctctctctctctctctctctctctctctctctctctctctcctctctctctctctctctccctccctccctccacactccctgatctcttcgagtggcctccagcatgcagtgtaaatctcaagacctctaagtaataaaatttttattttcatcttgtgtcttgccaaatcgttgaaagaatactctctatcttaaggatcctaaattaaaatacatgctataaacagccctacagagagaggcacatgtgccaaaaagcttatctttctggctaactgccagtaacaaccggagggcagccaacagccaaacaagtgaccttataagagaattccacccccagtggagactttaaataatcacaaccctggcaaagaccttaactgtagctttatgagaattctgaatcacaggtgcacagctaaatagtgcctggattcttaattcagacaaattgtgatataacaaatgcttgttgaataagttcttaagattgggggttattttttatgaaacaatacataaataaagcagttaagtattaatacatagactctataatcaaatgacctgtgatgaatttctggctccataattcttagcttctttatcttagtcaatttatacattttttatatatcaatgtccttgtttataaagcaggtataataatagtacctctcacatcaagttctttcaagtttaaaacccaaatgtacatacagagatcttagagcagtgcctgattcacagtaggcacttaaattttagctactgaagctcatttatttgaacaataatattaagactataaaaagttactaatacactttgcgaaattgagcaggtgacataatcaccttgggtctcggtattctttcattcattcaaaaatatttaataagcaccaattctgcatcaacctgcgtatatatttataataagagggagagaaagcaacaggaataatagtgctgccactaagtgaaagaggaagactgcaggagaaacagatttcagggagaatatacggggcagtcaaataccaagagtgaagttgtatgagctgtcaatgcttgtgcagttaatatgttatcattatctaaggagcattatctaaggagcagtcattctcaaacatttatgagcatctgatatagggcccaagaagttgcatttcaacaaaatgacaaataatactacagctgctgctccaggaatcacactacagtccattaatgtggaatatgttaaaacaataaaaaaagtgagtttgattattattatcatttataataatcggggaaaaaatgcttgtccccctaaatgtaaaaccgttcttggtttaattgagaaataattgctatggttgctgtggaatttagtaaattttataagtataaaatataaccttccaatcaacacatttttcctacataaatttaataaacattgcattgcacgtggaaattaataagtggaaatcttagttacactgtcagttccaaaataaacagacttagcttaaacatttgtttcaggtttaagttactagcgacatagaagttatccctatctatttaatgttgtgcaatgttaattaaaattgtatttaaaaattttttttcaaaggtttattcctactatgtattgactttgtattggaggccgtattaaatttccatatttgctcttacatttttaatatctttcttaggattttctacataaatagtcatttgtaaacaaatgtgttacgctcctttatttccaatcagtatatttttaaacgttttttcttgcttaaatatattagctacggtctctagtagaatgttaattggaagtactgaaggcaaatgtattttcgttcttcaaaaattaggaaggaataatcaattttctaccattatgtatgatccttactgtggaatttttatagatagcctttataaagctatttatatttttctgaaaatatttataacgaataaatttttaattttgtcaaaagctttttctgcacttcttaagatgaccatagatttttttaaattatagcaatgtggagaaaataccttaattgattttgaatgctaaaccaatatttcattcctggaataaaatcttttttatgttgccagatttgatcgttaaacttctataaaaaaatctttgcattatgtttaaggggtactcctctgtatttttaaagttttgacataatatggtctacaatgatgaattcctaaaatgagttttaggtattttccactaattttttggaaaaattttgtgtaaaagtattattttttcttgaaatattttatataatttaccaatgaaggtaattagcccaggatttttcttttttggaagatttttatttattaatttaatttatttaacagacatggtgttattctggttttatgtttcttcagttatactgtagtttatattatttaaagcctttgcacatttcatcaagaatgtcaaatttgacaaagatttattgacactttttcctttttattgttgtaatacttgtagtagagggtagcaaacttttcttctgtaagaggccagattggaaatattttaggcttctcagttagtgtagtctctgacataactcttcaaatctgttgtaatgtgaaagtagccatagagaacacaaaaataaacggatgtggctatgttctagtacaattttttttttcacaaaaacaggctataggcaatacttggttttgagaacttaatatgctgattctaatttagagatatctagatgtataaataggatcaactacaatgtgccctgttgtattacagatattgtcaatttgtgttttttcttttttcctcatccgattgtctagtggcttttccttttcatttatctatccaaagagcaaaattttggtttgatacattttctctatctatttttttggatataactttcttttctaaaagtttgggtgaatatttaaggcatgcgttttaaaccttccttcttttctaatacaagcactcaagatttataatttttctaagcatatagaaggaatttgtaccccacacgttttaataagatatttaaaaatctttttcagtttgaaatattttctaaatatccttctgacttcctctttgattagttagttatgtaaaagtgtgtttcttatttttcaaattgttctgaaattttccagatatatttttgttattggtttctatttaaattcctggtaatgagaaaccaaactctatataacttcaaatctttgatatttcctgagacttttaaaagaatcactcaacatatgttccatctcattaaatgatccatgtatgcttgaaaaaaatgtttatctattgcaccaccataattcagcctggacgacagagcaaaattctgtctccaaaaaaaaaaaaaacaaacccttgatcttatcctttttgagtatagtttttataaatatctgttaggttataaagttgtttaaatcagttttgtctttatttttgtctattatatcaattactgagaaatagatgttaaaaatctctaaatatatttatgagtttctgcatcatggattctgaatatctttattggttttgtcttcattggcattgtcatatcttttaaacaaatttactatttttaaattatgaagcactactttaagacggtgagtggcagcactcaccgtcttaaagtgtattttgtcggatattaatgtgaagacattagctttctataagtggtgtttgcatagtgcatcttaaattttaattttaactataaagtgaatattttatgatcagcatataattgtcttatcatcctgataagctctcattttaattggattgtttggtatctttatattttgtgtgatttgttatatgttttctattatgcctaccatattgttatttgacttccactgttttctggttcataacttttctaaaaggaagtcagtaataattcataatgctgttttctttatttaatgtcatatttttctagctgcttatacgattttttcaacataccttaaatgttccattatattatatgtgcttgaggttctctaaacttattatgtctataaattaatatcttttagcatatttggaaatttttgcctttttaagtcttctaaaaaaaagtcatcaaatatgttgttattccacaaatatctcttctctttctctaggatatcaagtacactgctcttaaattgatatgataaacctcttaaacccttaaaatgatatgataaacttcttgatatagtcccacagatcacaaagattcatcatttttctccctaatggtccctctatgctcttaaatcagatatttctattaatttgtctttacatttgctgactcttgtttctatcatgtttattatgacaatcagttcattcagtatttgtttttaattttagaaattttgttttttaaatataatttgcttttggtttaaaaaatcttattttggctaaattatatattttcatttattatgaacatgttttcatttatgtcatttatcattactatagtagctactttataattttttctgttaagccaatatttaattcatctcaatgtatattgcagttgattgcccctattttttgcaatgtaggtctgctatggtctagatatttatgattcccaaaactcatatgttgcaattctaaccccagggtgatagtattaggaggtgggaccttggcatgtgattaggtcatgataatggagccctaaagaatgggattgctctgcctgtaaaggagacctcagggagatttcttgctccttcacccagtgaagtcgcagaaataaaatttagctctgaaccaaaagcaggccttctccagatactgattctgctggtatgatgacattggacttcctagcctttagatatgtgagaaagacatttcttttgtttataagctacccagttgatggtcttttgctatagcaacacaaatggactaagatagggttatatgtgtttttaaaatcacacatagcctaactatgaaagaatgaaaaaatatatattcagtaaacaaaaacagccagaatggccataatgatatcagacaaaaaagactttaagccaaaacatgtcacaagagacaagaagaacattatataatgataaatgggccaattcacaagaaagatataactattataaatatacatgcatccaacatcagagcacaaaaatatataaagcaaacattgataaaactaaaaaaagaaatagcaagacaacagtagtagcatatttcaatattccattcttaataatggataaaacaactagacagaaaaacaaaaaagtaacatttaacttgaacaaaactctagatcaaattaaccaaagacacatatagagaacatgccacccaacaacagcagaatacacattcttttcaaatgcacatagaacattatttagaatatatcacatttggcaacaaaatatgttttaacacatttaagaagatagtaatcataccaagtaaattttctaatacatatggaatgaaactagagattgatagcagaagaaagactggaagattcacaaatacgttgcaattgacaacacattcttgaacaaccagagtcaaaaataaatccaatgggaaattaaaaaacatcttgagaccaactaaaactgaaacacaattcaccaaaacttatgagatgcagcaaaagtagtagtaagagaaatgtttatggtaataaatctctatgttaaaaacgaagagagttatcaaaccagtaacctaactttacacctcaaggacccagaaaaacaaaataagtccaagacaaatgaagaaggaaatattaaagcttagtatagcaataaataaaatagagacaaataaaatgataaaaaaatgaaaattagttttttttaaaagaccaacaaaattgacaaacctttggctagactaaaaaaaatagataaggctcaaatgaataaaagcagagttgaaagagaagacataattgatgccacagaaataaaaaatgacagtaagagactgctatgaaaaattatatgccaacaaattgagtaaccgaaaaagaaaatggaataaaattctgaagcaaaaaacctaccatttgtaatagcattaaaacctgaaatataagaaaccagatttatcaaaatatgtgcaagatatttacattaaaaactacacaatattgctcatagatattaaagaagaccaaagtaaatagagaccatgctccttggttgaaacagaatattcttaatattccaattctccccaaaatgatctatagagctaaggcaatcccaatcaaaatctaagctggctttaaaatagaaactgaaaagccattaagaagttcttgtgagtgtggctggttggtctagggctatgattctcacttagggtgcaaaaggtcctgggttcaaatcccagaggagcccaacttttagttcaaaagttcttgtgaaaacaaaaataatctagccaaaaatattcttgaaagaggaagaaatttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagaaagaggaagaaatttgaagatatacacagtctgcagccagacacaaaaaaattacatattggatttttcctttttatgaaatgtccagaaaagagaaatatataaagaatacataggcctgtgatttcctggtctgggagtagaaaggatactgactgtaaataggcattaaggtatttgtttaaagtgaagaaagtactctaaaactggattgtagttatcattgtgtaacaaatatttgtgaaaacaattgagctgtttgcttataataggtgaattttatagtatttacattatacatttataaaactttttaaagtatttttaataaagctgtgtcattaaaaagaccaataatctgccattcctaacatgtttagtaaaaaaacatgaaacacgcagcataaggattttaaaaagatacttttttgccaggttaattattttattttaaaagcgaagactatttttttcaaattaagttagagaatcacccaacattataattctctgggaaaatgtgaagttgtgacttataagtaaaaaaacctgaagaccatgactccagaaaaagaaaatctaatgcaaagaaattctccttactccaaattttgagtcccacacattttaaagattttttttcaaatccttttatattaactaatttatgatacttaatgggtcccagattatataaaaattcttattctatttgattccaaaatctgatggagcacagaaaacaaccaccacaatatcgatgagaagaaaacacaacaagatgttatttaggaatatcgggggaaactttattacaaagctgggaaattgaattcattttatattaagaatttaataagctcttctgaagatgaattcatttcatgaacatttcagcttataaatataaatacaattattctgtgaatggtacagagtgaaaaatttaatgattgtcttgatagtgatttaaaaattatataaaagtatataaacatctctatatatacgtataccacacaagcgttgagttgattttactgtgaggcatccacattaacatttaaaattcaaaaaacaattttttcaggcatataaatggtttaacatttgtttccggaaattctaacaagtgaaacttgacaagaaaacaaaaataagtgttgtgattattgaaagaaaatcaacatatacttctatttgctggtgatatgattattctattgaaaagaactgttcacgtttaaatgaatagcattaatgtgatacgcacaaaatagtaagcttatggcacagaacttttttgagaggccaatgtagaaaacaaattgttattaccctgatgatatttttataagagaaaacccactaatgtgttgattgaacagaatttctatcaaaatctcaatatacattttgatttaataattcaaaaaatatttacaaatactcaattagaggagataaaaatagattattcactgaatgaatgactttgatgcaactttctaacgattcagggaaatttaaagttagattcctcccccacatttactgaaaactaaatttatttcatagcaagtatatatatatatgtggtaagagaattattacaaatatagaatattatatgtaaatatgtataaaagtttggctggagaagaactgcctagttgtgacactaaaagtggagacaatttaggaacctatttaaatatgtaacaattaatattaaaaagcaaataattttttaaaaattataataaatgcaaataaaaagcattactatttcataaagagctcttacaagtcaataaaaatttaaccggtagaaaaatggataaaagttcactgaaagtaatctctaaaataaataatttgaataattaataagcatctaaagaagcattgcacatcaatacattgtcaaattaatacattttttaaaatgacaagctgtcacatttttctgttcaataatcaaaactaaaaatatgttgcaatatccagcagtgactacaatgaactgatataggcactatcctacatatttttaagaaataaaaactcgcaaattttctggatgtctacttgctaacttttaaaaacatttagcaaatggaatgtgcatttgttttactaaactattcctttcaatgaattaatcctaaataaataataaaagtatgacacagttacagggatctttataagttatgtttataggagcaaaaattagaactatacaagatgctaaccctctattaaagagtcatatttcctccatacaatggagaactgtgagcccattaaaacctgataatgtcatgatctctaatacatagtcaagtgtaaaaataggtagcaaatcaaaattatcttctctcaatgtacatctgtgcaagtctgtatatgctcacatgtgtgtgcataaatcagtatttcatattaatataaaatatctaggtgaaccacatgttgaccgtggctttgcattgggtttatttttatttttgtgtgtgttgttacaatagaatttgtataacaagaaagaaaaaagtaaatatgttaaagttaaaatatctacaaagtacaagaaatatgaattaaggaaaagtagagaaatggaatcctgagtcttataaagaataacaagaataatatctattgtgacccaaacttaaaaatttccctcttttgaccaatttctcaccctgtgtgttattagtcttcttttgatatctacctctaatttatgttggattaactgaggtaaagacacagacacatttctctgtgtcatttgtattctggcacctctctctatttggctcaacattagactgtcattttcattttctcaggtaattagtgataaccgtgtaccaaatattaaatatataattcatgacaattacagaacaatttcctggggatacaaaatatctgaaatataatttaccctctctgagtgttgccagttgaataaaagagtttaaagttattatgttgccttggctatgtccttatttctgtcttgcaatgcaattcacttttggattcttgcctgtattcctccaacagatcaagcaacacctaactaatagcgtaagaatctggccctctaattcaattcttgtacattttctggaaattaaacttgagaaattgacttctattgtagacttgatcttagattactgtccatgatctctggagtttttactcttgccactgggatcctaaatttgtccccttcctagtctatcagaaaagtacacccagcacattggggaataataacaattaattaaagacagaggataaagcctattgagacataatacttcctctatattaatgacttgggaaatgtatttttatgtaatcaacagaagcattgagtctctattacctaaattatctttatttgattagagacattactaagaaccttaagctttgtaataattgaacccaatattttcaatatgtgaaaagtgactttagtccttgaatattatttatttttgttatggctacacaaatgtatgcccaaactgtattctaacagatattgtggtaattatttgataacaattacaaattgaatggttttcatttaggaattttaaagccagttggagtgaaaatgtcctcatcttctctgggacaggtaaggaagtaaccagtaagtttgaaaaatatttggaaagttacatttaatttcgtaatcagtgtattatttcctttatgtttagcaaaatttgttggttcttgtaataagtttggggtcttcccccaactgcataaagatacataaattgggatttttgctgactcaagaaaccttagccaaatttcattgatatttcttcaccattcctctattaacaaagtttaaaaaaagataagaaatatgaactcaaagtatacttttatgattactattttttaaaatcacctatttttgtgactgctttattgaaacactgaatcacttcatgtatctgcctagtgactcaaaaagtgttattacaattcactttaaatgaaagtgccactcacaatcttgataattaatgcaggtaaccggctgtgtgagaaagttaacatcagccttaacctcatgcactgaactgtttttcacatgtcagataggcatttcattttgaggaaagccatgtttttgttccttttgtggttggaatttataattaattatacaacatggagatgctgtattttaattataaaacattttaatgtggaacacatgagacctaggatacagaatgtagcaatcaagttgtacaacaaataatcaaacctctaattatgaaagctacagtggttcctgaaatctaaaagcaaaagtcacaggatggtttatttaacaatagaatttattatattttatatcttcttcaaagcttactttgtttttcctcttataggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaatcagaataaaacttgagatactcatcttttgtataacttacatgaaattgtaccaagtgatgactttttaaatacagttctagttatttcatatttctactcaagtaatgtggtttgctccataggagttatttgaaaataaacctcttttcaaatgctcaaatctattattgttctgtcagttgtgcaactcataaatactctttcctattctcttcaaaacacagaagtaatattaaaatcagtgggaaatattcttagacaagtcattgatacaaaatattaaacatatataaaaagtaaactttaatattcaccatgtatgttattattttatattcaattttataatttgttaacacacaaaagtattatgtcctgaccatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctacgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagtgacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagttgcagggctatatataaaacacggccatctggctcaacaatccatgaagctgattaagcaatacacaataatgtagttaaatgacttgactcactagttaggaccagaattcaagttgcaattccctgtgtgattcttttcttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatggtgtccacaactgtaggtttacctaccaaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcacacttttaaaagcaccctataactctaacactaccttgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcagatcacaaggtcaggagatccagactatcctggctaacaccatgaaaccctgtctctactaaaaatacacaataattagccaggcgtagtggcgggcgcctgtagtcccagctactcggaaggctgaggcaggagaatgacgtgaacccgggaggcggagcttgcaatgagccaagattgcaccactgtactccaggctgggcagcagagcaagactctctcaaaaaaaaaaaatttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaaagtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttcaaaaaaaaaaaattttgtctataaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacctttcagtttgactttgaaggatcactttcccctgtcattgcgcccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggtttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttctttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccagtgcacccggcccagttttttcttttatggttagttctttctgtatctagtccaataatttttaatttagaataacacactgtattaagccttataaaaacaccagtaaattccaagatctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaattttttttgttcttcaccttgtgtatgaggagcttaagttgaatactctaatgggagaaggaatttgttcactcgttgaacttctcgttcagttggcaaggtaaatttgtttgtaggttagaaactgccaggaagtcctgagatgactgtcttttccatgatatcatatagggaccttgtaaatacgtttctgaaatctgccttctcagaaaactaggacatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgcccttactgttttagggacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatctttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgctttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccacgcctggctaatttttctgtatttttattagagacgaggtttaatcgtgttacataggatggtcttgatctcctgacctcatgatccacccacctcggcctcccaaagtgctgggattacggcgtgagccactgcgccaggccaccaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttggggcccagttgttggaacagagctgaatcctggatgtttcttttgtttttttcacctttagggttagggcaaaatttttggttagattcttcttcttctttttttttttttttttttttttttgagacagggtctcactctgtcacccagacgggagtgcagtggtacgatcttggctcactgcatcctctgccttccaggctcaagcgattctcctgcctcagcctcccaagtgcctgggattgcctggggttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtgctgtggcagaaaacatgaagcattttggagaatatggaaaaacgttattccttttttttttttttttttttttttgagacagagtctcgctctgtctcttaggcatgatctgggctcactgcaacctccacctcccgggttcaagtgattcttctgcctcagtctcccaagtaggtgggactacgggtgcgcaccaccaggcccagctaatttttttcgtatttttagtagagacggggtttcaccatattggccaggctgttctttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttctttctgtgtatagttctgtgaatttcagtacatgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgccatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttgtggtttctaccttgtcttgtctcgtcattctctaaatacatcaaagaacaaaagtgtttaattttgatgaagctagtttatctgtatttttctttaatggatattgctttcagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctgtttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcttgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtcttttcctcctgcccttctttttctttactttacgttttgctccgcttcatggtgagaagtgcttcagagtccccccatggctccaaaacagacatacagaatgaagattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagacttcttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtagcatgtatcaaaattacattgttttaaaggcagtattctatatagtattccattgtatggatataccacaatttatcatttcacctgatgatggacatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttattttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatatggagcaaccgaaactctcatacattactggtgggactgcaaaagtggcacagcactttggaaaactgtttggcagtttcttgtgaagttaaacatacacttatataagacaaattccaactgcttggtatttacttaagagaaatgaaaacatatgcctacataaagacccgcatgtatgtgaatgtctttggggccaggcgcggtggcataatctcagcactttgggagaccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcgacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagacgtgaatgaatctcaaagacgtatgctaagttaaagaagtagcacgaaaaagactacatatcatatgattcattcacatgatattgtaggatagacaaaactgtagagcaagaaaacagatgaattgtttccagtgctgggtgtaggaggaaaggattgactacaaaaggaacgagggaactttttggtatgatgaaagtatactatatgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcgagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcggtttctgatgaatcctcacagtatttaaccagaataactgtaggtaagttggtgcaatgttgcctctggaaacaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatccatatgcaggttctgcagggccaattgcaggacttgagcatgcagggatttgggtacacatcgggtgtcctaaccaatcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagtggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctgctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaatcaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaaaatgaggatattatatgggatgtatgttaaaaagtaaagttttaatgaatattaaaagatgtttttgaagtcttatctaaagtatgttctaaatgaagtttctgacaggtttttttttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctctttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcgtgaacccgggaggaggagcttgcagtgagccgagattacaccactgcagtccatcctgggtgacagagcaagactccatttcaaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtagtaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccacttcgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtccctgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaatattaatctgtatttgaatgtcattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaatagtgaaaactggctgggtgtggtggcacatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaacaaaaaaaaacttactaatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagatttttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatttcggctcactgcaacctctgcctcccgcattcaagtgattctccagcctcagcctccccagtagctgggactacaggtgtgcaccactgcgtctggctaggtaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccaggcctgctttggaaaacatattttctctgtgctagtatagtcatgacacatcagcctatatatcctcatgttcagcaaatgcacgttaactgcttttgaaattattattataataaatctgttactcaggtgctctcatcagatgttccttcaggtacagaaactgaggagaaagatgatggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccctgatacattgtaagactcacatgcctgtgacattccagagctattctcttgggacacttctattttaaaattctctcctgttcttttatctgcttgtctctatcatctatcattcatctgtcactgttttctagttctctttactttttttatggtactgttttgaggggaaccgtcacccacacttagccacaggctgctgaagatctgaattagttgtgatttccctattaactgtttcctctccacaagtacccagttattagtcacctgtgaataaaaagatggagtgacagaagttgagtttagagcataggatttatgagcatggcctctagagccaggcatggccatgctgtgctgggtgactggttaaattactttacctcttgttgcctcagttgcttcatctgtaaaaataggcatacttcatgggatggtgctgtgtatcaagtgaattatttttacatagcacttagaatactgctcaatacatagtaaagctcagtgcagtcagccattattagtagtagagttcattgattctaagatgcaagttttttcactttttaatatctctgaaatcagatgtgtatttcagtgaacaggtgtcatagtttaactggcagtgctttctctttcttagtttctcatgaaataatgatacatcttatgagtggcatcttatattcaggggatataatattgttctcattataattttgttacttgtgcaaagttgaagtgaattatgtgtaagatttcctctaaaaaaattctatgggttgcaacagactcttggctttgaattttcctgatcccaaattaatgtggcggtcatgttcccagagaatctttaagacagcaaaatttttctctccagttagctagaaaagcagttatgtgtgtccagttaaggagggagtatgcttatgaatagctttgtctgcagagaaaatgttcgtcagttgtcagcctctgaagggatatttctgtgtcttcagatataacttgtataagcgtttcttagttataaatgccttacttccaaaatttctgttagttttttttaagtggatatatggaatgttaagctattttaacagaggaacaagttgaagagtggtatattaatttcacagtagagccgacagaaaccattttaaccttgaacatacctgatacataatggtattagtcctataaacctagccatcatgtaagtgaaaccaatctgtatttcccttggagacaccatgaaatccattcacctctaacatagggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttgtttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttacacagtacaccttcttttgaaatacttacagatgatatttcaattgcgctttgctttaaacattttcacatgttggtttttactttaattacagattactccaattgtgtcagcaaactatggctcttcctgtaggacgaggaatgtttacctttttttcgtaccatcctgttccaacagagccattgcctattcctaaattgaatctgactggtatgttaaattctgggctcaatgagaaaggaaagtgattaagtacatgcattaagtgtagttctttaaattagttaaaacaaaagaaatgctccctctatccccagtgattttaaattttcctaatagctgctatagtggttatcaaagctcaaataccatgtcaaactaaaccttgagagaagcagaatatagttcgttactcatttttgctttttaatgaggtgatttcaagatatacaaagtcacttggagaagttcagaaagatataattgataatgatgagactattgaattttaaataatcttgagtataatatgtaaaaatatttagttttaaaatgtcttatgtcatagtttaaacagatgatcattgtataaatcaagaaatgtcctaagcaaaaagagaaaaaatggtcacttgcagtactcccactcttctgcatcactccttttaacattttaatatatatgtttactaagtttatttccacatatttataattttatatttgtttaattatcagaaaatttaaatctattttagatattttttaaaatttacagtgaacatccttttatatctagcaaataaatgtatgtgtttataattatgtgtatgtattgtatacacgtgtttttaatcgatacattcatttttatttgcttcagagtatttcattcagtggatataccatagtttatagaagcagcctggtattgttggaaattacagttttttggtattataaacattgttggggcgtattcgtcctatgtatttaggctaaatgcttagaagtagaactcttaggacagcaagatgaatggttttaaggaacatgtcaaattgcctttctggttggtgcaagtttttatttctgctatgtataactgtagttatagtcttgattacaatgagttttttagtgtatgtccgcctaatgctgatttgaatgtgttctaaaggtgacaattacatagttgaaattatcattgaaactctattatagtatatatggttttgtgaaacctatacaaaatgtatgtgtaatgtatgttgtagtagtgtatagtatatgtagtagtatataatgtataatttaatatatgataaatagtacataatatatgcaaacataattgtacagtattttaaattgcatactttaaaaaatccagagttccactcagatttgtgaacagcttgtgctttgagcagcatgcaggaaatgagattgactaagtgaagaacacattcccatctccatatcatgcttattctgagccctaatctcactgagggacatagtgagcagagttgcttttaatatttaaattgtctcagaggtaaagcacctatggcaaaattttaacaattattgattcttgatggaaggcatggtatatagatgttcattttagtagtctttccaactgtttatatgaaagatttcatataatgagtgcgggttaaaaaggaaatctaatgcaaaattggcaaatgttaaaatgtattcaatctgggtgatttagcactcaagcgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtcttttgcatatgatgaatgaaagtttcagaaagttcactcagttttttcatattgatatgtctgccttttttgagaaagtgcaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactctgcatctacttaaaatttattttacataacatcttagaactctttaaaaatggtacttttaaagctgcagtgaaatggataactttatgcagtaattaaaatatttatgttaattattttatctgtgacttaagacagtattcaaaatatatttaaaaagattcagtgtttgctgtgtataatgtagatcaaaaagaaaagaatcaagaaaaaattcgtagggaacatatagcattgtgaacatataatttacattgttcttaaatggaccataaaagtaaatctagtgaatgcccttttgaagttcactgggtgactcaagtctataaaaggatgctttttacaaaactatctctaagcattttaaacaatagcatataattagatatctatatctgtatgtatatagagagagagaaaaaaaagagagaagggggcatatataggtaagagctgtagcagatttattaaggttcttgtgtctttttttttttttttttttttgagatgcagtctctgtctgctgcccaggtgggagtgcagtggcatgatcttggctcactgcaacctctgcctcccaggttcaaatgattctcatgcctcagcctcccaagtagctgggataggcacgcaccaccaggcctggcttttgtcttttcttaagatgtcatttttccttaatgtccaggggaaaatataggatagaacatttgaaattaacatcaatgtcatcagatgttgggatttataacttgtatagtttaacagtgatgttagtcttcattttggtttctaagctctctactgtttgaaagaaagatttcaaagcagtgattatcccagtcatctctgtataatgttaaattggtatcagttatctcattatatagcctcatacattttagcaaaaaggacaatgaactgtttagacagtgatggtttttccagttccattaagtttgactcacatgtacaaaagttttaagtggtcatagagacctaacattccaggcattatggggttaatggttttgaatgtagaaaatgtaagtaatcttagtctcaaagatctaaatttaacaatcttggttttgtgaatttttattctctcagtgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttagccaatgagtatgctggctttctcgtggctctgggtttgaatgggtaccttaccaagctggcgactttcaatatccatgactacttgaccaaggtgagacctgtgctcccagtgcctggctttgtgccttgcctggctattgtagtagctcctaattgctctatttgctcttctttcttcattcttgtacttctaagtccatttgtctcatagtacgtggaataatctttctaaagcataaatcagagtatgtcacttctctggtcaaagccatttaattaatgatctcccattgcttttttttttttgagtaaggcagggtagaatttaatgagtgacaggaaagctctcaacagcgagaggggacccgaaggtgggttgccagccacgaggctgagtctagaggtttttatgggcttgaaatgggggaagtgcatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgttttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatctttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccgggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaaaattcccaacaccagagggcaaagggggatcgaccattgctcttaatatacattctaggagctggtgtgatcctgttcacttctccagccctaggtggtaccactgttcttcgttttttttttttttttttttttttttttgatgtggagtctcaccctgtcacctaggctggagtgcagtggtgtgatctcgtctcactgcaacctctacctcccaggttcaagcaattctcctgcctcagccttctgagtagctgggattacaggtgcacactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttattttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctatgggtttgccttttctggacctttcatatgaacggagtcatacaaaatatggtattttaggatgggcttctttcacttagcctgataattttagggttcatccatgttgtaccatctatcagcaatacattcctttttattgttgaataaatgttttattttatgaatgtacattttattcataagttgatgaacatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaactgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcctgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatccggctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattgggtccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaaaattttttttttttgagagagtcttgctctgctgcccagcctggagtacagtggtgcaatcttggctcattgcaagctccgcctcccgggttcacgtcattctcctgcctcagccttccgagtagctgggactacaggcgcccgccactacgcctggctaattattgtgtatttttagtagagacagggtttcatggtgttagccaggatagtctggatctcctgaccttgtgatctgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttgtgtgatttttttctttaatttttattatttatttatttatttagagacagagtctcgctctgtcacccaggctggagtggagtggggcgatctcggttcactgcagcctctgcctcccaggttcaagcaattctcctgcctcagcctaccaagtagctgggattacgggtgtctgtcagcatgcctggctaatttttgtagttttagtagagatgggatttctccatgtcggacaggctggtctcgaactcgttgacctcaagtgatcctcctgccttggcctcccaaagtgctgggattacaggcaagggccagcacgtccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacataatatttaacagcttaacaacataagtaagtgacctccttattcattatcatcattcgaacatgtttcaccacatgtgatgtgtggatttgaaagtaatgaaaacaaaatgtaagatatttcgttgttgttgttgctgagatggtgtctcactctgtcacccaggctggagtgcagcgacctgattttggctcactgcaacctctgcctcccaggttcaagcgattttcctgcctcagcctccccagtagctgatattacaggcacctggcaccctggctagtttttgtatttttagtagagacagggtttcaccatgttggccatctggtctccaactcctgacgtcaagtgatccacctgcctcggcctcccaaaatgctgggattacaggcatgagccagcacacccggcccagatgttttaacaaaaaaataaaactttttttttgaatactctttcctttttccctttaaaatttttttctactacttggtaatttttttggtaagactcaaagtttcacagtatttgaatatcattgcttataaagacttaaattggcaatttaaaaagaactattttgggccctttttttttggtaggtaaacctacagttgtggacaccatttattatagtgtcataactttctgaatggagttatattccattcgtatgtccagtgcaacttgctagaaagttaactctaagatttttatgagatgagattttgagaagctagtttgaactgtgttgcttttgtttttacaggacggcctcctggtcctgaaatggaatactgcactgacagagagtcatactccttagctgctggcttggccctgggcatggtctgcttgggggtaagcatagcctatgccttcccatgcttcagttaggacatctacatgttgagacaaataacgttgacacctaaacctgaatattgtcccttactatgacttaatctgctgcccagctctattgtctttttggatatttttcaaagtaccagatttgcaaattgagagaaactgtggtcaagagtgggactttaagatttcttttcctccagcttgcagtgttcatgaacaaactgaagggaataaagttttttttttttaaagcgttcaagacatagaatgaataagtgacagcccactatgactgaaaacagagaatagtgaaaacgtatatgatcgggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagattgggggttcaagaccaacctgaccaacatggagaaaccccatctctactaaaaatacaaaattagccaggtgtggtggcgcatgcctgtaatcccagctactcgggaggctgaggcaggacaatcgcttgaacccaggaggcggaggttgtggtgaatcgagatcacaccattgcactccagcctgggcaacaagagtgagactccatcttaaaaaaaaaaaaagttatagtggaaggaatttttttcatgtgtgttctgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccgtctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgagtcaagtcatttaactacattattgtgtattgcttaatcagcttcatggattgttgagccagatggccgtgttttatatatagccctgcaacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtcactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttcataaaatttcttttcactcgtctgttattgtcttttccagcatggcagcaatttgataggtatgtctgatctcaatgtgcctgagcagctctatcagtacatggttggaggacgtaggcgctttcaaacaggaatgcatagggagaaacataaatcaccaagttatcaaatcaaagtaagtacacagcaaagtaatagatcaaaagtctggaagctgggaagttaattggaaaatactagtgttcatactgacattggtaaatgtgttaattttaagcatagttattattcagaggaattttataataatttagaactcttttacatgcataaactcttctttcaataggaaggagataccataaatgtggatgtgacttgtccaggtgctactctagctttggctatgatctacttaaaaaccaataacaggtatttctacccactcacccttcctcccgcggtgatagtgtgatatcctccctgaccttggttgtaaaattcagttatctcatgtgtttctttcccctgtgctggattaagctgattttttgttctttcaagtactgtaagtttttgaaagaaaacttgcagtatttgaagttataaagattttacctggaaataatgtatttggctattttaatggtatttgacaatatagttttcaatttctgttcatttctgttttgtagttgatgtcagtaacacccaaacaatgcccatgtttgttttcattaatttagcatattgctgtgaggactggttaagccagaaatacttatcatttagtgtgatcttggttaccatgtaaaacaatggtttttgcctacttcaggagcttttgtaattaccaaaccgtctaccttcctaacttgctatattaatgctgacgcttgaaagtaagatctttggcatttatgcttacactttgcatgaggaataagttgagtacaagacgttatgtcatgtcttaagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggctcacgcctgtaatcccagcacttcagaaggttgaggcaggaggattgcttgagtccaggagtttgagaccagcctgggcaacacaggctgttctccatgactgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacgtagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggttttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgttcggagcatgtttaaggtaggctaggccaagctgtgttgtttggcaggcaaggtgtattaaatgtattttctttttctttttttttttttatgagatggagtctcactctgttgcccaggctggagtgcagtgacaccatcttggctcactgcaacctttgcctcctgggttcaagctattcttgttcctcagcctcctgagtagctaggactacaggcgtgtgtcaccatgcctggctaatttttgtatttttagtagagatggggtttcaccatgttggccaggctggtctcaaactcctggccttcagtgatctgcccgccttggtctcccaaagtgctgggattatagacatgagccactgagcctggcctaagtgtattttcagcttaaggtattttcaacttacaataggtttatcagtacataaccttactgcatttgcatatacttatttttcaaaattctcaacagttgggaactgattcttaaattgttctgtttattattatcattgttataaaatgtatgaactttacttgctctaattaattttatctctgttgcatttttaagacacttgctcgatgcctgattttgtgggatgatattttaccaaattccaagtgggttgacagcaatgttcctcaagtaagtacatataataaatattatatctttagtagcataaaattatgatttcttatgggatttttcaaaattctgtaaaatattttttcttatgaaggcaatattgatcattaggatacctcttaaagacctaagaacttccattttaagattctgtgctgcacagaccaccgccttctcttttagcctcaggtccctagaaattgtagtttttaaaaattaaatatgaatatcggtgttgcgtgggagttaaaaaatgaaaggaaaaaactaaatatgtttgccagaatactctaaaaaagtgttgatatttttgtcataattaagtgcacatttctaagatgctattttacttcgtgacaattttagatctcctaataactcttttaattactttatatcatatttattcgataagccaagtatactagttaaaaatgaacagatttttttggtaaaaactgaaaaccgaatattgtaactagccactgcccttagacaactgtccatgtctagtggtctcagtttctttatgtagattgtttctttcagtattttcagaggaaaaatctcaaagattgaaagaagttaatatgaacacccacatcaccaatagactctataataatattttactgtataaacatgtttcatcacttatctatccacttatctattcctctatctaatccaacattttttgatgaatttcaatgttagttccaaacagtaatacactccatcccaaaattgtaccatatatattaactggaattggtatttacattttttccttttaagataaaatttatatatcgtgaaatgcacaaatgttaagtatcctattggataagatttgactaacacatagacctgtggaaaccagcctctatcccttgtgccccttccctctttgtgcattcacctgtacccccaggtaaccaatatgtattttgtttatctcccaaaatatgttaatttccagatgtagaactttatattaatgaagccacatatggcatatacccttttgtataagacttctttcagcgttttcaagatattgagtatattaatagttcatcctttttattattaggtggtacagattgagtatttcttatctgaaatgcttgggaccagaagcgtttttggattttggaatactcgaaattatacttactggttgagcatccctcatctgaaactctgacatctgaaatacttcaatgagcatttcctttgggcatcatgttaatgttcaaaaaggtttggattttgagcattttggattttggattttcggattagggatcctcaacttgtgtattccatttgcaatcctattaggtggggctggaattactgaggcatagggtagatggtatatttagttttattagaaatgataaatcttttcccaaagcggctgtaccatttgacacattgaccaacagtgtttgagagtgttggctgttgcccatctaaccgataattaatggtgttagttttttaagttttagtgctgctgatgaatacgtaatgatatctgactgttgtttaaatttgcatttctctgctgactgttaatgttgagaactttttcattggtttattggtcctccgtctatctttttttgtgaagtgtctgtgcatgtcttttgcttattttttaaaaaaatttgtatttttattactgcgttgctggagtttttttaatgcattctagaaacccgttctttgtcagatttctttttttttttttttgagatggagtcttgctctgtcgcccaggctggagtgcagtggtgtgatctcggctcactgcaagctccgcctcccaggttcacgccattctcctgcctcagcctcccgagtagctgggactacaggcacccgccaccatgccctgctaattttttgtatttttagtagagacggggtttcactgtgttagccaagatggtctcgatttcctgacctcgtgatctgcccgcctcggcctcccgaagtgctgggattacaggcgtgagccaccacgcctggcctgtcagatttcttttgcaaatatccctcccaatctgtggcttgcatattcattttcttagtaataattttaatgagcagaagatattagaatgttaaataatgtctgatttgtcagttttttcttatggttattctctattcctatgaaaaaaaccatttgtctaaccccatcatgaagataatcttttctgcttttctctaaaagcttccaaagttttagttttgtgtatacttacataattcatttcaaagtaattttgtatatgatatgaggtacatgttgaggttgtctaccagggaagctcatcagagactcagcacccaagtttttaattgggagctgacatgtaggtaaggtactctctgccttgtatgtacccaagttccagattctcaggagaatgtgtgttagcctaaaccacgctgtttgtagttcaagcacggtaaacacagatatatacattttgttttaaagcaaccggttaatttacttggaatcagattgtcattctttcttggttgctagctctaatcttggtgcacgtctttatcctgtgggctgttggagtctgccctgtgcacacatggttcatggatcaggcagacatttgcacagaatttatatacagagcttggggccctgtctctgtggctctctcctttgtcatattctgtcctcacctcccaatgggtgtggtattttcctgtatcctggttgttaaggccaagaaggttatgagcttttaattgtagcttttgccatctttcttggcgcagatagacctgctttcagagcagaaaccgcagaaaggaaaatgtatctagtggtgttcctctcttccatggatcgactctcccctctagaatctgcttgcgtttgtcctcactccagtgtcttgaggtcaggagttggtgaattaagcccacctgatttttagaaagaaaattttattggaatatggccatgcccatttgtttacttattgtctgtagctgttttttgttacaaatgcatagatcagtagttgctggtatttactatttgacccttttagaaatagtttaccgacccctgccatagatagtttggattttatattttgtctagggtttacacttggtgtatgagttgatctgataggaatttattcatctattatttgaggaagtagaactcctaggtttgtttttatttgtttagttcttccagttttgttaatcactgatatgaaagaggtgaggaagaattgttttaaatgactcgctcatttgttaccataattttaactctagcatattcagatgtcagagattttagtttttttgaaagtgctctttgaaatgtatattgtaggatgaaatactttttctttcactccttcattcagcacatactcatgaatcctctgtaaatgcaaggcacgtgctaaactctgtaatacattaaagatacatcagacatatagagtgttctcaaaaaactttagtttattaaatgcactaagttcagcttactgagattaaacatgtgtacaagtaactgtaattccaaagtggaaagtataaattcatgtcagagagtggtcttttttgcggcctggtgtggtgactcgtgcctgtaatcccagcactttgggaagccaaggtgggcacatcactcgaggtcagagttcgagaccagcctggccagtgtggtgaaaccctgtctctacaaaaaacaaacgaacaaacaaaaaaacacaaaaaacagtggtcgttttttgtttttatgaaaatatggtttttggacttttagtatagaataacatctctctcttttttacttcagactttataatgttatatttggtctttattacatcagggatactgcaaataggagagataacaatttcacagttctcctgattgatatttcctatcagcttccacttttctctgggttctcatctggagctacattgattctggagcagggttccttgtagtgagcaacctagcgttaaaaggaggatttttttttttaaaggtcactttgtaaactgcttgtctgtttgaacttagggcatatgtaaaataacaactagcatcttcatagtactttttctttcataaaaagctttacatacagggtgcggttactcacgcctataatcctagcgctttgggaggccaaggagggtggattgcttaagcccaggagttcaacaccagcctgggcatcatagtgagatcccatctctacagaaaaatacaaaaattagccaagcatggtggtgtgcacctgtagtcctagccacttgggaagctgagatgggaggattgcttgagtccgggaggtagggctgcaatgagccgtgatcgcaccactgcactccaacctgggtgacagagggagaccctgtctcaaggcaaaaaaaaagaagaaagatattttaagtctttgatttggtgatattcagtacataagaagactgtattataagtgccttctaatatttatttattttattttattttatttttgagactgagacagggttttgccctgttgcccaggctggagtgcagtggtgcgatcttggctcactgcaacctccacttagcaggctcaagtgattctcgtgcctcagcctcctgagtagctgggattacaggcccagctaattttttgtttttcagtagatacgggtttcaccatgttggccaggctggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttgttacagctagatattctgtgtatgtttttcggtaaattgttcattacctatactaaaaggaaaaggatgtcttttctaaacaatagttgtaacatagctgataaacatattgacagtttagcttatcttagcctagtgaataacctcacctgtggtaggtatgttggattaatgctggaaacatcccgtaaagaagaagtctgattagagttgtctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctatttaattattattattattattttttttttttgagatggagtctcactctatcacccaggctggagtgcagtggcgtgatcttggctcactgcatcctgcacctcccagattcaagtgattctactgcctcagcctcctaagtagctgggattacaggcgtgcgccaccacgcccagctaatttttgtacttttaatagagatggggtttcaccatgttggtcaggctggtctcgaactcctgacctcgtgatccacctgccttggccttccaaagtgctgggattacagtcgtgagccaccatgcctgcccttaattattattcttacttagcccatcttagatttgaaatttgattacattcaatgagattaaaatataggcttttgagtgaaacggtttggtaaagcttactttgtataaatatagccatgataagcagtatgttattcttcagattattaaatatttgtaatgagaacattgatatctaagtattcttgctttctatattgacagattataagagaaaatagtatctctctcagtgaaatcgaattgccgtgctcagaggatttgaatttggaaactttgtcgtaagtgatgtataatgcaaattagctatcctagcgtctatcagataattaaattgaaatataccatgtgggagtaatattgtccttgatttaagtaattatgaatcccacatgtttctaaccattatttatcagatgttcatgacgttggttaaagctctctgaagtacagagctcttgccctcaaaaagcaatattggagatttaacttgtatgtatttgttttttatcctttccattaaagaaattggcaacaattttaaaaattgtttttgctgcatatgaaactgtaggcaaggggcaaacttcatgagtaaggtgacccgatgcttctgctgaaaaaaaaaatacatagaaatctgctgactgagggcacttcatcattcccagaaagatataaactagcttagagaactggaatatttattgttacttatttcaagttaattttaaagtaaaataatgattattaaatttcttgtcacctgttttcagccaagcacatgtctacataattgcaggagcctgtttgtctctgggtttttgatttgctggctcagaaaacttaccagcatttaactgtttggtaagaagtattttagtttactgtgttctttttttttgtttgttttaacaaagctttaagatgcttcttataacttggaattttttcttttgtttttctagcataaatttgccaaagattttatgacttatttgtctgcacctaatgcttctgttgtaagtctttttatcattctccttgggaataaaattaaacttgaaaaaaatttactgatgatccagttacttatgtgttatcagatatctctgctgtttttttaaatgtagaatgagagatctgaagaaccattagctcatctttttatttttgttttgcgatattaacttaggtgagaatatgattaccctggaaggatgcacaggtatctagttcttgtgacaagagaataaaaaaggccataatattcacgggttgtcatacctcatgtaattctgtctcagtattaaatattgggaatttcctttttaaaaaatattagtacttagtaaggattcagttgcttttgaggcattgcttctctgatgacaagactgagagattttatttcctggtaaaagctacatggatttatgcaacactatttataatatggaaaagttagaaacatcaaaaaagtctaaaagtagttaattaaatttgattatggtttatttatatattcttacacagtggagctaccaaaatcacgttatacaagaattttttgtggctgggtgcagtggctcatgcctataatcctagcaactttgggagaccgaagcaggaggatcatttgagcccaggaggttgagatcagcctgggcaacatagggagaccccatctctacaaaaaataaaaaattagccaggtgtggtgacacacacatgtagtcccagcaacttgggaggctgaggtgggtggatcctttgaccccaggaggttgaggctgttgcatcactgcacttcagcctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgtgtaggtaaaggaaaaattcagagaaaaagccaaaacgttaacaccagttatctttgggtgtgacattccaagtgattgttatgtcttgatattcaatatttgaaattatttctgttgaacttatatttcataatcagggaaaatatttgtatttacagatttttttttttctctgagacagcgtctcgctctgtctcccaggctggagtgcagtggcgcgatctcggctcactgcgagctccgcaccccgggttcacgccattctcctgcctcagcctcccgagcagctgggaccacaggcgcccgccaccacgcccggctaactttttgtgttttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttatagtgatgtcatctcttcacctgacagacaggtcctcataacctagaaacttgtctgagcgtggtgctgctgtctctccccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctctgttcttcagtgcattactgcttgtgcccacctggttaaaaattttaccattctactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctagtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactgtaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttgtatttatctatgttaaaatttttatttgtggtaaaatacacataacgtaaaacttatcaatttttaggtatgcaattaagtagtgttaattatattcacactgccgtgcaaccaatctccagaaatttttcatcttgcaaaactgacattctatagccattgaacaactccctgtttgcccctcccaccagcctctggcagccgccattctactttctgttttgatgaggttgactgctccacattggtttagctttgtattgatttctgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttctccttctccactactctgcagtaccacatctattatataagttaagtgcctatacacctgtgtttatttctgggctattaggttttgctggtctgtttttctgtacttgcaccaatactccattgtcttatgagtcttggtatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaaggctgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttctttcatatcgaattgatttttctaccattctgctactgcttttctagtgatttttggtttttaaatggtcatgtatactctgtaacaacatttaaacttagcatagctacaccattatgtttctacccaaaatttctaacattagtatcttaatatttatctttgaattttggtttatcaaaagggtacaaagaaaatggcttattccatgcacatgccaaaatagatgtatctctttgcttaaattttgaaatctcttctttctaatccattaaatatataagcatatataatgaattataagtccttatttaatactccaattattttaaaagacagggaaagagatttgggtatatgtgtgtgcatgtttgtgtgtaagaaaagtatttatactcaatagttttagaagtggttttatgtgatgtcctacaccatctttatttcaaaatattttttagaaaaactctgggactttagattaatttgcctgtttgctatactaaatttgagcaacaataaagtaatttaaggaaaattttaatagaccctttaccaagagaatatttttaaagtctatgaaactttatcttaaaagtgtatcatattggtgaggaaagaatttatatttagaggaatagttgtttatacagtcattgtaactttttttttttttgagaaggagtctcgctctttcgcccaggctggagtgcagtggtgggatctcggctcactgcaagctccgcctcccgggttcacgccattctcctgcctcagccttccaagtagctgggactataggcgcccgccacggcgcccagctaattttttgtatttttagtagagatggggtttcaccgtgttagccaggatggtctcgatctcctgacctcgtgatccgcccgcctcggcctcccaaagtgctgggattacaggcgtgagccaccgcgcatggcctcgttgtaactttttaatgataacttttgccttttcatttagtcagtcattctaaaggaatcatcatgcttcacagaaacagaaaaaaactgtttaaataccaattacaacattctgtatttttaaaactcagatttataattgtatatttatatacataggcatatacataggcatatacattaataaaattggataagaaggtggcatacttggtacatgactcttcaatatttataatttctaggactgcattcatggtcttcactactctgctattttatgttaaaaccttgcttcaagggttgaaatttaacatttatgggatattactttggctttaaatagtgatgatcttgaaatggcccaaggactaaatgaaaagtggaatgttcacaccactgacactcttgtattatgagggcatcttatcagtatgccttactattataccccagtttcctgattctcaagaatgccttgaaagtatgtgcaatataatcaataacatctgtccccaccgaacttactttgcagttactctttgagcacatcaaattcttccattgccgctcttctctgtgccctttatccgcacttcccagctcacagcactgacaaccggtgagtctagtgattctgtcttcaatgtgatacttattaagttctctaaggggatcatttggttgtattttggtttcatggaattatttccaaattagcattgttttgttcttcaacttagttatattcctggctaaatcttttaagaaaattatctcacaaagtattagaccagaggataactttggacacctgatgactgaccagtcttccaccattctcagatctatagaactgctctaaacccaaaaggagatcaagtaaagttgtctttagggaaaaaatcatcaggtaaaggatagttgccaagggaagttcaggatactttttttgtgctctaattatttaattccaagagaaaagtttgtctgatttagtggcaatgtctgtatgagtttctttttttcctttcacatagatgccgagaaattgtgtataaatgacatagacgggacaagaaaagcaaaatacagcaaaaaaccagagacaatttagaagtggcagtgagcggtagaacttcaaaccatgtagaagcagttaaaagctctgtgttttagggtacgaggaaccaccaacacttaagtttccctagatatagtttgagacatagcagatctcttgcatatgggggcagagaagaaaatagcccctataagacacctgagccctgtgctcaactgaaggcatcccatgttgtctccccagagacaggtcaagagccctttattgtttatgggagaagggtcaggagcacttatcacagtaacctaagccatcattttaaactacactacaatgtataaccaacgacagaagaaagatagctgttttacaaaagtagcctaatctgaagaccacactctgatggtaggtgcagcacaagaatattgttaagttaatacacttctgacatgtggcctcatgcctgtcatttaggaaagattttttgagttgttaaagccaattattggctagggtacagtggagagccacactcacatactgctggtcatagctatttggcttagctattgtaaacgaagccattttccattggtgacaagaatctttttttttttttttcgagatagagtctcgctctgtcgcccaggctgaagtgcagtggcgtgatctcgggtcactgcaagctccgcctcccgggttcatgccattctcctgcctcagcctcccatgtagctgggactacaggcacctgccaccacgcccagctaactttttgtatattttagtagagacggggtttctccgtattagccaggatggtctccatctcctgaccttgtgatccgcctgcctcagcctcccaaagtgctgggattacaggcgtgagccactgcgcctggccggtgacaagaatctttatgtaatttgttagtgtcattttttctgatctttattgattttatttttaatagatttatagaaataaatgtatttgagtaagaagagggaagttactgtctataaagctttttaaaattgaagtctcattttatccttctttttttttttttgagacagagtctcactctgttgcccaggctggagtgtagtggtgcgatctcagctcactgcaagctccgcctcccaggttcacgccattctcctgtctcagcctcctgagtagctgggactacaggcgccagccactgcgcctggctaatttttttgtatttttagtagagacggggtttcaccgtgttagccaggatggtctcgatctcctgacctcgtgatccacccatcttggcctcccaaagtgctgggattacaggcgtgagccactgcgcctgggcgatttttttttgttttttcttctgagatggagtcttcctctgttgcccaggctgcagtgcagtggtgtgatctcagctcactgcaacctccatctcctgggttcaagtgattctcctccctcagcctcccgagtagctgggattccaggcatgtgccaccaggcctggctaacttttgtctttttagtagagatggggtttcatcatgttggccaggctcatctcgaactcctgacctcaggtgatccacctgccttggcctcccaaagtgctgggattacaggtgtgagccactgtgcccagcctatttttcttttatgagatcttaaaatatgaaaacttttttgtttttacattctaaaatagaaatcttaaagtttaaaaaactgtttgagaaccccaaagaaaaatattgccatacccacatagatgtttgatgtactgtgtttcaaggacgtgtgtatatgtatgtgcaagtatgtatgtgtagaagaactttgctgtctgagaagaattgacatcctgtcttcccccttcttccctatcaatccttaaggaaaaagaaaaaaaaatctgagaagataaaaacagatgcctatgttgagtagaaagggatttttgagagtgattgattttataagtggtcagtttgatagtaaatattttcatattatgatactttttacctccctgtaaaacctcttcactgtgaagactaaagtaaagaattattgggtcaaaggtcagttatataaaatttttaaaagataatttctccattactttttaatagaatcttatctgcctttaagatttctgttcatttgaagatattacttgagcttctgtcctgtcttagcttataggcaacagcagattgcagagctcatattgtcacagttgtttgttacccactctctgtcttttttgtgaacaggtatcatctccaggctctccggcacctctatgtgctggccgcggagcccaggcttctagtgcctgtggatgtggacacaaacacgccctgctatgccctcttagaagttacctacaaggtatctctccctatcatttacttgtaattttattaccactcatccgtctttgcaggtcataatatttcaaatgtgttgtccagtaaaaggtgataagtaatgaattgaactttcataaaaatggaagcttccaaagttattgtatatcctgccaggccattcatgctcatttatatgatctgggtatcactttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttatgccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtgttcgggagttgggtccaaggggtcaattcaacagaatggcatagcgttaaagatagctaaataaaagcctctgctttcttcatgtattgtagcagataagaaagctgcagcaggaggaaaagtcagaaagaatagagcaagtcttttcttagagatctttattgatagcttaggtggcctcagaacatgatttacattcattttttgtctggaaatggagcttgttaccttccagatgcctctttctggctgttattgtttcctctgagaaacataggtttcagtttgtcagatgagcatatttttcagctttgggttgactatgtttacgtttatcttgacagattaaagtaaaaggcccaagatactgggaactgctcatagatttaagcaaaggaacacaacacttgaagtaagtacattaaatttctcaaatttaccttttaggaagtgaatagaagtatataagaaggtataaattatagattattatctggaatgtgactcatcaccctttaatctcattcaagactatatgtagggtatgtcttctgtaaaacagtctgtatctttgaaacaagacttgtgttagaaaatgaaagttttaatttcaaactccaaccctaaatatttatttattgagaaacttgcactgacttccttgtgacagtaatggacttatctcttggtatattaacataagatttagtttaagaaagtgtattagtccattttcacactgctataaagaactacctgagactgggtaatttctaaagaaaagggatttaattgactcacagttctgcctggctggggaggcctcaggaaacttacagtcatggcagaaggcaaaggggaagcaaggcatgtcttgtatggcagcaagagagagagagagaggtgcaacacttttaaaccatcagatctcatgagaactcactcactatcatgagaacagcatgagggaaatctgcccccatgatccaatcacccccaaccaggtccctctcctgacatgtggggattacagtttgacatgagatttgggtggggacacagagcctaaccatgtcagaaagtaaagctgatttgtacacgcacaaaagaactttattaatcagtgtttatcagaccacatcttttgttgcatctctttaccattcttttgctagaaagttctcctaaatttaagattattgtagataatatatactactcagccagtttattttgggtggaaataatcacgtgcagttattttagagtgttgatacatttatacctaaagtagcatgtcagttaagcctttaaatttcaaggaagtttaacaagcatgtaaaagtttttatagtttggtcccaatgtgaatttttccagactgtatattagctgttttctgtattgttctgtccttagatttgcagcattattttcttcttgctgcaaaccaattaatagatatttagtacctcatgtaccctaggcatagagctaggggatatagggaatacaaagaaatgttagacaaaatgttatcttcgaagctcataattgagccaatagtcaaagtgcctcctcatttaacaagttccatgaatctagacaccaaagaaaaacagaactttattctaggctttctcatagggactgatttaatcttagacacagtaaataatcatttaccttagtggaaaatggtaaaagcttcatctcctgtgaacatggtattgggaaaacactgtttccagccaagaactgccagtaataccttatattaaattcattctttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgctggcttcctcgcccattgctataaacttcaaaggtggatctgcttcctttttcattgttgcagattgtaaagactgactgtggctctgtttgctttttatgtgataaaataaataataaaatataatgaatataaaatactgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatctcggtgaggataaactgatgacagattcagacttcttttattagtttgctttattatttgcacagtacttgactgccagtgcagtagtgtttgaaataaggaaatagttacgataaatgagggtaggaagcaatctcattcccttggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccctaaggaataattagacggcaaaagtggggcaggcagactggatgagtggcagccagaggactgagttagcatcctttgttcttccaagtacggagacagcagtttattttaattcaactcatatttcattttagtcagttacttatgaccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagcagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataacccttctttttattgttcatacacctgttaccttcaagattccaagggtgctgagcagatttttctttatttttttgttttttgctttttgagacagggtcggttttttctgttgcccaggctggagtgcagtgacgtgatcatggctcactgcatccttgacctcccggagtgaagccatccttccacctcagcctcctgagtagctgggactacaggcatgtagccaccatgcctggctacttttttaaaaaaattttttgtagagatggagtctcactatattgcccaggctggtcttgaacttctgggctcaaatgatcctcccaccttggactcccaaagtgctgggattataggcatgagccactgtgcctggcccagatctttgacttaatccaccatagagacaaggaaagattggatgcatatatggccttcagaaaatttctcaacctctccaaaatgtagtttcctcatttctaaaagtgattataatagaacctaccttacagtattgttttgaggattaagtgaaataaccttcccctctcttttttattgaatctttactatacatgggacactctgctaatacttaaatgtcatttaattatgaccctgagaataggtattttatcattctgggcttacagatgaggaaactgccactgagagatgtcacatgcccaagatctcacagctagtaagagctgggctgtgcactccaggtcacgggtctctaataaagcccatgcccacccttaaccccagctggacttgactctgccacctcccctaaacttgttctggtcagtgttttttttcttgcagctttgttactcggtttcctttctggatcctactcttcccagcccaacccaaggcatagctctgtgatgtcctatctactcattttgtcctagtttggtccattcctctcttctgtagcacttactatccttaactgtctcttgggacttaatttttttttttttattaatgtttaatgttacatgtgctgtggcttttttaaaagattgtagtgttacttttatgtcattcattataaaacttaagaatgggccatagtagtgctatacaatttgtttttgaattgattttggaatatactttgtgctacaaaacttctgattttctgcagaaacaggaaattctggatctcttttcttcagtactctatgaatgtgttacccaggagacctcagagatgttgcctgcatacatagcaatggatcaggtatggatccaaaaacctataccaattctggtgaaatttgtcctgtagttcaagtaactcactgaatagtgtggtaaggttcctagtgtccttccttttagtttcccatttgcttttggaaatttaagaaaggaaaccatataaaatttgaaagctctcaaaaatccaaaaagcttgggctttatgttgacaggagtgccccttggggggctgtcttcctttaagggttcccattcctcccttttgtctcccctgactaggagaggaggggagcactcccttcctctctcccatcttatttttgcctccctcctggcaatgcctctttgtagaagtctgcatgtgagccgttagtgaacagaaccctagcgatggcagtactgtgaaattagacctatgtgatgaagcttgcaagaggttacagagtccatatgcagttatctaggcattggagttcatttttaaatttctcttgttattgctattttaaaagagcctaaaggggtaatgcagaaaataatgcttaataatgttcttaaaggatcagaccaatttattcactttaggcaaattagtaatacatacaccttttcagtattatcatatctttcagacccagatttggagctaagccaagccagtagttttctaacctggcagaaatttgccttggtatcttaaaaatacagatcctttaattccatgtctcatctattgaatcagaatttctggggtgagatccagaatctagttttaaacagctctttaagtgaatatagtaagttcacagctgagcatctgagactcagtgtctaagagaaataacctttaatgataaaaataatttgctaaaaagctgaatggaaaaatatatttagccagaggataattcccccaaaccagaaaacacacagtgttaagtaacatcattaaaaaccaagttccaatataactaagtaggcccagaatgccattattgtctggaatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatctcaagggcagtattattagtagtgttcttcttgccctctaccccctgggatctctgccatgtcattgtacccagcttgagtttcccagaggtgactggctatgaccttttgggtcttggttattcggagctgttgagccaagaatgagctcattcacctttgttacttttccctgcaagctcctcatgtagggccatattgaaggaggtgagccattcacctgtacccagtgacggcgcctctgtgggcagactgcatcaaaacacagaatggaccaccccccgaccctttataattcggagccacatttaaaaaatactcagtctacaactctgatgaagagacagagcactctttgattaaatagattgttgtcctctttcctcttcaaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaaggtaatagtagcattgtagcatagcgctcttgtgcttttgagatacattcggttcaggcttttctgttgtaactttgttttttcattggtaagcaagataaatctgagtataagcaagaatggctatagatttaacgtttccagctagatgaattagactttgattatctactttagcttctttagtaaaatacatctgacccaggcagataatatttatagcattttaaataccacttggtgctcaggaccttgttctctcttccctagcatcagatcacatttcctttccagtgcctctgtctcctgtttcctaggggtgtggcctgttgccttcctgaggccagcagccatcctgtttttgtactggcaccacatgtacatgtagaagttgacgtgtgcttgctgagtgagcttgttgtaccaactcagttttgaaaacctgggaccgcacagctatgtgatgtcacagtggtggctttctatcagcaggatttgtgattgcaaggaaattgtagttactcgttaacagtgtagaagtgattctgacttacatgaggcaagcgatggggcctttagatttatggaaatgtgtctgtgtgttaaatacacctgaaactgattttcaggagtagactccttgatcttttcattctttttagttcattcaaatgctcccagtaaatatctgacagttgcttgctttgggttaatactaaccttagtaatagtagtagaaacaattcttgctttgattagtgaaaactattagtaatcaatagaccctaagcgtttgaatataattcagtttaaaactatccacctgtaacactaggaaataaatttctgaaaaaaattaaattgtaaaccaagttgtgagggatatacttggaaagcctgattgcagactctccatgtttatatttaaaagctgcattgtatttgtcatttcctgttcagattcaaagatcatataacttcataattttttggatagtcatttttatcctcatttttggggaaaaacatgttatttcaaaggttttcgtgtttcgtttttattcaatttaacatttgatcacctatggcagacctttgctattgataataaatacttccttaaatctttgcagattccctgatttgcacatttcatataatgtatggaactttggcagtgattagaacattctctaaaacagggccctgattgccttgttgctctttagcgcatttggtggtttccagcattgctgtcagcctccattgaatttgacttgccacacagatttatcaaaaatgtgtttattttttagtgaaaaactagaatttttttttaaaacaaaacctcttaaatatatagtctcctctcttacaagcactagcagttggcattggggtagagaacaataaattaactgaaaattggaaattgcattcatatttgtgtgtaaaaatcacagatgcatatgtggactttcaggatcactcactaacaactcattagatctgagataacccattgaatcactacactaatctgaaaatgcagccaatttatattatataaatgtcggttttgttttttctttttttgagacagagtctcgctctgtcaccagggtggagtgcagtggcgcgatctcagctcactgcaacctccacctcctgggttcaagcaagtgtcctgcctcagcctcctgagtagctgggattacaggtgcatgccaccacacccagctaatttttgtacttttagttgagacggggtttcaccatgttgttcagtctggtctcgaactcctgacctcatgatctacgtgccttggcctcccaaagtgctgggattacaggcgtgagccatggcgcctggcctatataaatgttttgtacagtatttatctcctcaaattataattttgggcaaagaaagcgggtttcaagtttaagaactttaaaaagttttattaactttttcatattttgttatggaaatttaaagaatatacaaagtaagtagactagtgtaataaaccacaacaccaattttaatagttgccagcattctcctatttttgcgtcatttgtaccttcacccattgccacactcaattttccaaattgtgccattttactttcccaccagcagtggattgcaatgcaatttttggcattgtcctttttttttttttttttttttaagacttgtcaagtgcagtaggaaagcaaagtaaacccaaagcaagcaaataaaagcagaaaccaatgaaaccaaaaacagataagcaatagagaaaatcagtgaaacaaaatgctggtagacatgagaaagtcattgaagagaggctgaaccaccatgctctccttcatgatgagctgttcaaagaagaatctcatctgttctcccttaacctttctccctctgctgcctcccccaaacctaaatgtttccacctcccagtagactgacatcctcacaactgtgttcagtggagtctacagttttcatctcactccatctctacaatggtgaggcttttagctacattttccttcttgaaatgagcctcccttgactttgtcatagcacactttcccaatttttaaaaaaaatcctctttaaaaattctcagtatttgtcaccatttcactgtcactcctttgttgacccttttggaagtcatccttgctcctttccctccttcccttctctgcgatagctgacccattgctgatgcctttcagtcctcatcatagatatttcttgaatttgtccacattttactatttctacctagaacagaatgatgattttgtgcctggaccactgttatagcctcctaaatagcctccttgctttttctcatctccattccaaccatctcaatttaactgacagaacagtcttttaaagaataaactgatgtaacactcctgcttaaagcttttcaatggctcctgattcagctgtgaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtttgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgcgacaaggggtatttcggggagacaaccacagtgaccactgcacctttatagcactcatcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaaggtaattgcatatctaagtcttatcttcagtacctctgttacctacccctttacgttctagtttctcagtagttactgcccctagtttgactttcctcttcattaatgttgcagtgtcattgttagggactgttttggagcaaaaaagaaaaaattatcaactttatatatgaataactttcatttttattcagaaaaggatggattcttcttcacagagccccaaacactgatctatactaataaactaaatattccatattattctttactaattgatttttttattaaagctatttttctttattttctaggttttcagttgggttttttagaatcacatataatcttaatttctaatattacaaagctttacaactaataaatacctaattttgtgtttgaatttttttataatagttttaaaaattaatagtattatcacctgattgtatttttcagaatacagaaacagataaaaaaaatttatccattaagctgaatactaagatatgatgaattctaagcacccaatttttctgagattctcaaaaaaaatattttctgataagggcaaagattgttccatttaatcatttaaacttgaagtttaattacattactagttttttgctgttttgcaagcctctgataaaagtttactatctagagacttctggttatggccatgatggaattgcttgtattggactcacttgccctcaaaaacaaatataaaagctaaaaaaaaaaaaaataagaaaagggaagtacaacagggagagctttatattcaccctagcttctcccccaaaggcatttgccagttcatagtacaagaagtagagtgccagcaaaaagcagcaatgctgcagggctgaggagccagaggttgggtttgtgattgcccaagagcctagaacttgaggaacacagtctcaggcaggagagaacgatagaaatcataactcagactctggatatacctttcccttgagttacttaatgatattttagccttcatatacatgggataagacttcaagagatctagcagaagccacaaggccaaaaatgtaagcaaaaatgtcagcagcagcataggactgaggagacaaagggtggaattcaacgcttgttaaagtgaagtggctctgatcagcatcccagctcctcaggtgaattaatacatggccaagccctaagcctgctctagcctaattttagatctggtctgcttcagtttcactccaagcagacttgacctacaattagcctagagcagaactaaggtgatctgtgtgctttctccccacctgacagaagaaaatgtaaccttcataggagaaagaaaacatacccagagcccccacaatttttagtctacaggattcagtgttgaatcaaaaattatgaaacataataataataaaaaaacagataatagaaacagacttatgtgtgattcagatattggagttatcatactggaacttaaaataactatgtctaatgtttccaggaaaatagaaggaatgatagggaatttcaccagaaacctggggtcaataaaaaagagttaaatggaaattctagaactgaaaaatatagtaactgaaatgaagatctcagtattggattatttgaagtgaactggaagacacttatctgctggaagacaagtagaaagtaaacaaactgaagcacagagggaagaatggttaggaaatacagagaagagtacaagagacatgtggaaaccgtgaaaaaaaaaataaacatgcatggggttggaataagagaataagaggagagaaaaaatgagttagaagcaatatttgaagagacagaagctaagaattttgaaaaatggtgttaaatattaacccacagtgaaccctaagcaggataaatacaaagaaaaccatacctagtcacattaatagtcaaactactaaaaggaaaaggaagacattttaaaagtatagacttcttttcaggccaggctggacaaacagggttgttcaatggtcaactgtattagaaccagtaaaataccacttagatagtatttgaaggtagacaggcacttttgcacattatatttaaagaatttatatatatatatatatatatatatataaaattaaacaatattagtagtttcacatgtagttataggtcactttctgaagtctagaatgggtaaattctatcaaatcatatacaggtttgagtatccttaatctgaaatctgaagtgtttgaaatcgaaaacgttttgagcaccaacatgatgctcagaggaaatgttcattacagcattttggatttgggatttttggattaagaatgctcagccgaggctgggcgcagtggctcatgcctgtaatcccagcactttgggaggccgaggccggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaagaattctcagccagtaggtgtaatgcagatattccaaaatctaaaaaaatccagaatccaaaacacctctctcttcggaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaactcatacctaagggagaacagcttttagaacattgtcgatgaaagcaaatatcagctttaaaagagagaggacagaaagactgcagatggtctggaagcagcatttttaggccatctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccatggctcaaagggaagtgctgcagaaaaacatttggctgttaagtgttttggcccaaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctgtgcccatcttttctacttagatagatagaaataggtatcatcgcttccatagacataattaaagaaaccatacaatttacacatacactcagagtggtggttctttccccagtagacgctgacatctgcgttcctcccttgcaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttggtgggaggccagggtgcctgtgggcagatgggtcagagtgtgggccaggatttggagtagaagccagagcatgtgaaaatccaaaccaggaagacttcgttgcctcccgcatgcggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacatcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatattggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattatatgaaatcttaaaataagttattgattgattgaagcagagtctccctctgttgcccaggctggcatcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtatgagccactgcacccagcctaaaataaaatttttatactaaattcaataaaatatataaataactggaaagtcttaattctcagtgcttgccttgtctctgtagttaagggacctgtcacactcaggcactcttccttgtgatgctgtaggccatgtgctttaagaactcaggcacactagctcattaggggagcttaacataaggatggaggttggaagctagttggtgccactcgtgtttctttcatttgtcttacgttcgtttttgtgcatatcaagaatattttagaccaggcgtggtggctcacgcctgtaatcccagcactttggaaggccaaggtgggcggatcacctgaggtcaggagtttgggaccagcctggccaacatggcaaaaccccgtctctactaaaatatatatatatatatatatatatatatatatatatatataaattagccaggtgtggtggcacatgcctgtaatcccagctactcgggaggctaaggcaggagaatcacttgaaccagggaggcagagattgcagtgagccgagatcatgccattgcacttcagcctgggtgacagaggaagactccatctcaaaaaataagaatattgtaagtgctgcttactgtaccaattcagaaattagggcagtttcatcagctggaaatgtggataaatgtatgcaactctaaagttgaaggaagatgcgttagcaaatccatcatggttagcatccctagctgccatctgcctgccccgttggatctagagaagatgaggtcaaacctttctcactccatgttctatgcaaatttctgcaaatccacagagcagggtgtaggtgctgtctccaatgtcacttccctccaaactccctgctctgttgcactaattcatttgtggttcatctcactgtgccccatgcgtgggctgaatgtcagtcagcttggcatcttcactgcctccttttgtctctccttagcttccagctgttttccctatgtagtgtcagatgagagtcttccagtgggagatgcccatgcagggcctggaggatagaggaggaggtgaagcctttactctcctgcactggctacagcagacacagggcagatggcatactcctgactgcaggaagctaataccagctgtggcaggtgtcaccactcctgagtttctggaagtttacaggagcttctctgtcctctgcttccttcattttcctgtttggatctctgagcaaaatccatgaccccttgagggatgcaatgctcagatgtaaagtcgtccccatcctcgagtcccaccaaaaccacccactgccactcagggactaggctttgcttctagaatttctagccctctggttacctcctctgagctcccagtgctgttcacttttccattctcaaatcctcagttgttctctaaaatgccagaatttctttgcaatttcctaacccctgaacaaactcacctgggtggcaccaatctcaaagctgcagcagtgggtctcactatgctttcagtacaaccttacataagttcagagaaagcctggactgaggaaatgaaaacctgccctgctgctcatcaggctggtgattctttatccaatccactggtggtgagcccgtgggttgattccatgtctctgctattgtgaatagtgctgggatgaacacgtgagtgcacgtgtctttttgatagaacaatttattttctgttagatagatatactcagtaatgggattgctgggtcacatggcagttctcttttacgttctctgagaaatctccacactgctttccacagtggctgaactaattgacactctcaccagcagtgtgtaagtgatcccttttctctgcagccttcccagcatgtgtcattgttttacttttttaaaaaacaatagccattctaactggggtgagatggtctttcattgtggttttggtttgtatttctctgatgattagtgattagtgatattgagaatattttcgtgtttgttgactgcttgtatgtcttcttttagaagtgtctgtgcgtgtcctttgcccactttttaatggagttgttttttgcttgttgatttaagttcactgcttctttgttgtgggagggggaaggcggggatgggcgggagctacaagaaaagaggcatcccctcagacactgggttaaagaaggaagaggctctattcagctgggagcattggcagacttgcgtctcaagaaccgagctctctgaagaaagagttcctggcccttttaagggcttacaactctaaggggtccacgtgaaagggtcatgatagattaagatctatagatagcacatgtggttagagtgcggggttaatctttttcagcttttacttcctccttctcttcagagacaggagacagtaagagaaatggcctctctcctcattcccccctttgagaacctcactcactagtgggagttctcactttcatcttcactatccaggtcttcctgagagacagctgaggtcttttgatgaactaaggtggtaacggagcctcttagtgactggagaaatatgggtaatgtacaggggagtaacatgcaggttcctaatactattattattcctattataagagttttaaatcctcctagagctggaaaccattttccaaacaggaatccaggatcaagcctatgccaaacctgcacgggcacatgtgccagctttgtcatgtctctaactatcctcatgcttcggctatgcatggaccagtcagcttctgagtgtgactggagcagggcttgtcgtcttcttcagagtcactatgcaggtgttgtccgggcttggtctcgcctcccaagtctcagttggccgggagcgtccgcagacttgtgtctcaagaactgagctctcatcttttccttgaatgacctgagagactttgttaacatttgtggccttctgagctcccttctttaacccttccagaagggcttccctgtatgggtttagcctttgcataccctgtctttcatttgggtcccagtgggggtctgttcctggtaattggatcctcacatacttttgggggttttggtaatcagctggaacatgttcttccacccacttagttgctgcttggagcactctcctttcatctgtgttaaagaggtacatgagcaactggtggcaatcagctcaggtggggttgtgggtctggataatagtttggagcaaaccaattatagcttgaggcttttcagtataggatggggtattgtttttcagtataggatggggtattgtttttccaattgaggagatcgacagaggtgaagggtttgtacacaaaggcatgcctttccactatatgcccatcctcatctacccagtatactgttgctttctcatgggcatttgtatcccagttctaggcctcaaatgggctgccaagggaggggtttctcctgaggtctcacatcctgtcttttctaccctgggtggcctaggggtatgtaggccttgggaagctcaggcgcagtggcctcaggagtgggaggccttcattcttggtgaaacggggggccactggtgccatttcttgccatgaatcttctgatgttgggtcggacaggacttcaggagctgactcccctcagcgggtggagcaggattcttctttggctgtctgtccctttgctactagtactgctgctgcctgtcctcttaacgactgtggggggtctaaaaccagctgtaaccaagtgtctatgtacggaaactggtctgggtgtcctggcttaccagttaccttgtgccatacctttgaaacaaggggccagtctaggcttccttctgatggccaacctacttctaatgctggccagtctatctcacacaaagttctaagttttcctggtgtcatagtaactccatagtccccattaaatcctttcttgaaatttttcaacatagttcctagtggagtgggcttactttgcgttccacccatcttcctcctgagacaaaacaacactcacaccacaagaaggaaagtctgaaggggtcactcactcatcttgcctgtctcaaactcaagcactcattcactttcactttcctttttgcaaacaagttaagccaaatcaaaatcaatattgagatcaaagtgccaattgcaatcaagtcaagtcaaatcaaaatcaatactgagatcaaagtgctgataagggcacattgtgggtgatcaggcgacacttccactcaaatggagcgggcaaattcccaggactggtcctactgtattccagatgtccagactccaagtgccggttccttcccggtgttcagctgctgcattgatcctccatggggccctgccgtgcactgctgtgatgaggcattccaccagggcaaatgcctacccggcagtgctctcaggatctgcattgctcaagctggctggagtcccccacagggatgctccgcagggcaggccaaagctgcctaaggggctccctcaactgtccattaatcacctcacttctgggtcagggaaccaagaaatgtagcaggacaagccgcagacaaaacccctcagacaccgggttaaagaaggaagaggctttattcagccgggagcattggccgacttgtgtctcaagaactgagctctcatcttttccttgaatgacctcaaagactttgttaacatttgtggccgtctgagctcccttctttaaccaggtgtctgaggggttttgtctgcagctcgtcctgctacagtgacacttagcctcagtctcatttccagtagggtcaaactgatgacctgacatacttattttctgtgctctcagctgtgtctaaatatccctgtgaaccactataaattcatgggcaatcaagcgtggcccaaaaatatgaccagagtggcgcaaacctgcctacaatagcccttgaagctgattgaggcagtgcctagatgccctgcaagaaggctggtgacacctacccctgtctgaggcatcttcctcatgtctggtagatgctctcttcctgctcctcccccattgtccctggggctcctcaaggctctcgaggcagccactgatggccaggttctctgtgggagttggctctcctgtcagccctccttccttctctcttttgcccacattccctcctctcctgtcttcccccaaaattcaaaaactgtttttattcctgctgcatccccaatcattcatctggagactcacaggtggtcccttccccatcccctgagactccttgggagaagatagttcaggatccgagacttggtctagtacaggaatgagtgatagccaccctgagtgagtgccttcatggctctctggagttccaggcccttgaagcggagcttacacttacccagagtgcagcccatgacagtgtgaaagagcactggctgtagccaagcgttagggaccaaatgcttccaagattccagagcgttggtctagattcactgatgtcatcacatcattccacgaggaatggctctttggtttataaaaggcactcaaggaaaaggccatgagcctcacagggaagggggttagtgtcccagcccgaatgctggagtcacctgctcttaccccaacatgaccttcacgtggggcctcatcttgtgttcaatcaaatccattaatgatttcaaatgaaaatgttacattcacatagcagaaaattgagaatatgcaaaattaaaagttgattaacctctcatctatactacaaagttacaaatattgtttatttttattgccttatttgtgtttagtatcatattaaaatttaaaaatgtaagctttaatattttgagataatcatagattcacatgtgattgtaagaagtaacacagaggggctctagatacccctcatcaaaatttctccagtggtaacaacttgcataactatagttcaatatcacaataggaaattgagtttggtacaatccattgacattgttcagatttcatcagtcttatatacacttgctagtgtgtgtgcattttgttctatgcaattttatctcatgtatacacttgtgtgaccaccaccaagttacagaacagttgtattataagaatacttcctattactttttttagaacttcatcttccctaatccctggcaaccactaatctttacaaccttataattttgttatttgaacaatattgaccaggcatggtggctcacgcctctaatccgggcactttgggaggtcaaggtgggcggatcacttgagctcaggggtttgaaaccagcctgggcaacatgttgaaaccccatctctacagaaaatacaaaaattagccaggcgtggtggtgtgcacctgtagtccgagctacttgtagagccgagttgggagaatcacttgagcccaggaggtcaagcctgcaatgatctgtgtttgtactattactggtggtgaatccacgtgggtctgcagcaacctcagttcttgcctcctcagaagaaagaattcgactgaagagcataaggcagaagaagagactggggcaaattttagagcaggagtaaaagtttattaaaaagctttagagaaggaacaaaaggaaggaaagaacacttggaagaggcccaagtgggcgacttgaaggacaaaagtgcagggtttgttggggtttggtatgcaggcatacttctggggttttgtgttccttctcccctgattctttctttggggtgggctgtctgcatgcacagtggcctgctagcgcttgtgagaggagcatgtgcagtgtgctgactggagttgtatgcatgctcacctgaggcattcttcccttaccagctgaatgcccctaggaggtcatacaccagttaaactctgccatcttgcctcttagtctgcatgtgtgagcctacttgttcaactcctgagattttactgggaagctactgatcaccaggttcaggtgttttctatttatcaggaaactgcctttctctggcactggctgtaaccaattattattttagagagacagttaacaactgcttgaccatcacctggtggttgcctaacattcctggtttggggttgtgaggggctctctcctgccctgctcagacctgaccagctacctactataacagcaccactgcactccaccctgggtgacaaagcaatcctgtctcaaaacaaaaagaaaacaaaaatgaaaagcccccagtattacctaaatggaaccagccagtatataatctgggattggtgtttttcacttagcgtaattcctgatatccagccaagttgttgcatgaatcaatagttaattcatttttattgcctagtggtgctcccagtcatatgataagggcacattgactttgtaagaagctgccatactttgttctagagtggtcctgccattgtacatgcctgccagcagtgtctgagtgatccattttctccgcattgacagtgtttggtgttatcattattttctagtttaaccatataagactgtggttttaactgaagtatcttttcaataacatcacacagttggcaaataatgtttatcctttgcccatgtcttctcattattgagccataatttttaaagatattttattgggtaaacatatttacataacagtaaatgccttaattgtctttgtatattctaaatataatttctttatcatttatatggcttgcaaatattttctcccattctgtattttttttttttttttgagacggagtctcgctctgtcacccaggctggagtgcagtggtgagatctcggctcgctgtaacctctgcctccggtattcaagcaattctcctgcctcagcctcctgagtagctgggactacaggtgcatgccaccacacttggctaatttttgtattttcagtagagatggggtttcaccatgttggtcaggctggtctcaagttcctgatctcaagtgatctgcctgccttggtctcccagagtgctggtattacaggcgtgagccaccacgcctagccctgtctcttccttccttccttccttccttccttccttccttcctttcttcctttctctttctttctctttctttccttctttctccttccttcctttccttttctttctttcttcttcattctttctttctttctttctttctttctttctttctttctttctttctttctttctgtctctttctttctttgtctgtcttcttttctttctttccatctctctctccttccttccttcctttcctttcttccctccccttccctcccttcccctcctccctcccctcccctcccctctctcctcacttcccctcccctcttctcttctcttcttttttctttctctcactacattgcccaggctggagtgcaggaacctagattcaaagatacaattttagcactctgtaaccttgaactcctggcctcaagtgatcctcccacctcagcctcctgagtagctaggactataggcccatgccacaatgcccagctcaaggagtgatactttgtcttgtgcatcctctgtcttgcctttccacttagctatggcctggctagagttcttaatgagagaagtctgctataatcctttctcccaaagagcctcctttatacactacatggtcactttcttccatatacgagagaagagtaagcttgctctctcacatcatcattaccaaatctcagctgggcaattaaaggaaatacttggatatttacttatccaaatacttggacaatttccaaagtagaattatcacagttttggctttgagaaagaacttggtattattgcaggtattttgggaacacttatataatattttctattatacttcttgagaggggttggttatttagtgacatgaattaaggcattataatattaaagaatggggcatcaatttcattggtaagtttcctcttcagcagaaaagagataagaatgttcatttatgcataaaagaacttgtcaaatgctttttttttcccatcagttaatatgatcatgtaatttttcctccttagtctgttgatatggtgaattacactgattgcttttcaaattttgagtcagccttatatccctggaataacttagtcatggttaagaaaaaatatatattgctgaattttatttgttgacattttgttaaagatttttatatatatcttcatgacaaatattggtctgtaatttttaaaataccgtttttatctggttttggtatgaggttaatattagtttcataaaataaattaggaagtattccctgactttttttttgtaagagattttgtaaacttggtgtttaaacttttaaaaacatttgttagaattctcgagggaagttatctgaatctagagatttcttttatgtcagttttacaattacaaattcaatttcttaaattatctatttcatcttgagtgagttgtggcagtttgtaagtttcaaagaagtagttcatatatctaagttgacaaatttgtttgtagagttgtttatagtattcccttattatcatttaatgttttaaatatctatatcccctctttcattcatgatattgataatttgtctttgttttctttgttagatttgctagaggtttattttattaatcttttaaaataatcaactcgttgtttcattgattctctactgtgtttctggtttcaattatattagtttctgctctttactatttccttccttctttctgttttggttttcttatatttatttattttagagacaaggtttgctctgtcatccaggctggagtgcatgattatagctccctgtaaccttgaactactggactgaagcaatcctcccacctcatcctcctgagtagctaggactacaggtgcatgctgccacacctggctaatgttctttattttttgtagagatggagtcttgctatgttgcccagtctgatcccaaactcctggactcaagcagttgtcccagttctgcctcccaaatcactgggattctaggtgtgaggcaccttgcccggcctgttttggttttattttgatctttttctaatttttaaaggtggaaacttagattattgatttgagacttttcttttcttatgtaagtatttaatgctgtgaattttcctcttagcactgctttgggtacatttcacaaattttatgtgatagtttcattttcattcagttctatgtattttaaaaattttctgagaaattgagaactttctttttgacccatggattacttataattgtgttgtatagttttaaagtgtttgaagatttttcatatgtctttctgttattgatttctagtttgattccattatggtatgaaaatatactctgtatgatttcaattttaattttgttgagatttgttttatggccctggatatggtctatcttgataaatgttttgtgaacatttgaaaagataatgtgtgctgtctgatgtcactggggcaatgttctacaaatctcaattatattcttttcattgacactgtttttgtgttcttctaaatccttgctgattttctgcctagttgttcttttttattatcactttttatttctttatttggtggttttgcctagttgttctatcagttgttgagagagagtgttgaaattttcaactataatgtgatttctctctttctccttttggttctatcagtttttgctttacatattttgcagctctgttatttgatgcatgtacatttaagattgctatgtcttcctggtagattgactcttatcattatgtaatatccctttatgtctctgataatctttttgctctgaagtctgctttatctgatattaatagcaactcctgctttgttttgactgatggttacatggtaacatggtatatatttttctcatccgtgtatgttgaacttacttatattcttatatttgaagttaatttcatatggatagcatatagttgggtcatgatttttaatccactctgccagtttctgttttttaataggtctatttagacaatttacatttaatataagtatgagatattaaggctaagtctgccattttatctatctgtgcttatttgtgtgtttatctcttttttttctctgttttatcttccttgctttcctgtggattgcttgaaaatattttataattccattttgacttatagtgttttttaagtgtatttccttgtatcaattttttagtggttgctctaggtgctacatcctgtacatgtaactcaggaaagtctatttgagttgatgttttatcagttcgaataaagtgtagaaacttcatctccctttagataactttaccctatcacattgataatataattatcttaaatagtttctttctatatctcgagaagtatattagacaatgttataatttttgcatcaaccatcatagtttagaaaacttgagaagctaagtgtagcatatatttacccttattttttctctttttgtcctttcttactttctgctattagaagattctttctatcatcatttcctatccatctcaagaaatttccttagttattcttttagggtaggtctgttggcaataaatcctgtttgttttcctttatttgacaatatgttgattttccctgcattcctaaaggatatttgtgctagatatagaattaggggttgacaggtcttttctttcattacttgaaaaaaatctgtcacctctagtctctgttgtttctgatgagaaacacattgtcatttgaattgttttcctcttataggtaaaatgtcatttcaatgttttcaagatttcttcctttagtttcagaattgtgattataatgtgtcttagcacagattcttttgagtttgggatttggaatttgctcagctactcgaatctgtagctttttgtcaaatttgtcatttttcaaccattgtttctttgaatactttttaagccccatactctttctcctctttttcttggtttttgatcatgcaaatgctagaccttataaaaatagtcccatggatccctgaagctctttccccctgccttagtatatattctttttctggctcagattgggtaccttctatttttctatattcaagtccattgattcttttctctatcctcttgtttctgttcttcagccatattgctaaaatatttattttgtttattgtatttttttcaattctaaaatttctatgtggttcttttcaatatcttttttgctgagacgtttttattctttcatttgtttcaagcattttcataattgctcactgaagcttttctattttagcgagtgttctttgacattgtgttggcagaggggaaaagggcattgccttcttagtgccagatgggagtggaagtccaggttacccatttggcaccattgacacctatgctgggaaggggttccttgttactgctaggtagaggtcagagtctaagatttccatgtagctttcaccaacactactgagggggaagggcatgcttcattaatgccaggcatgaatgaaattcctggatctcatctggttttgtccaacaccattctggctggcgtgggatgggtagggtgctttgttgtagccaggagaggatgcaagtctagattctccactcagcctttgctaacaagtgtggggctggagtcacatttttttcatggtgtttggctgggggtgcttatgttgtagacagaagttttctgccttgttaggctgacttttttctggtcctttggctggggaagcttttcttggggccttttttttttttggctgtgcctgttggtatttctaggttgctgcttctctggcacccagtttgagacataagaagccaaaaagaggccaggcacaatggctcacacctgtaatcccagcactttgggaggccaaggtgggctgatcacttgaggtcaggagttcaagaccagcctggccaacatggtgaaaccccatctctactatagatacaaacattagccaggcatggtggcaggcacctgtaatctcagctatttgggaggctgaggcagaagaattgcttgaattcaggaggtggagattggagtgagctgagatcacaccactgctgtgctccagcctggatgacggagtgagtgagactctgtctaaaaaaaagaagccaatcagagaacttataaccatgtcattcatttcttatgtcctgggatccttattcagtttgtcttctttccatatttcaaagtctttcatgcttcatatataatgtccagtgtttttgcagcacttagaaggaggaatagagagaaatttatctactccatcttgtccataaccagaggttcaagagagtaattttattttgccattaaattttgagtgtctagaggccattactgttagcaaactttcttcaacagagggagtgtttaccctgaaagctgcatttatataaaaaataaggtaccaaaaaattaggaagaaaaatgcaacctgagagtatgtgataacttcatgtacacttcttttctcttttatttgttcactattatacctaaaagttatgagaatagagaataacattaataacgttctgacaatccttggaattctaagagaatataagacatccctctcttattttaagaaagcatggaatactgatcagcaaaaaaagaaacgacttgggtggatatcaagggaattattctgagtaaaaaaatctttgagggttatatgctgcatgattccatttatatagcattattgaagtgacaaatttatggaggtcgagaacagatttgtagctgccagtttagggaagagggtagggagagggatggctgtggctatgaaagaaatagcatgaggattccttgtactgtgttatctgtggtggtggtggtcatacaaatctacacataataaaactgcatagacacacacacatactggagtgcatgtaaaagtggtgaaatatcaatagacgaaaggattgtatcaatggcaattttgtggttgaggccagacactacccagagacttcagtgaccctcccctgctggtgatattgtactatatagtcctgcaagttttcaccattggggaaactgggtgaagggtgtatgggagtctctctagtgtttcttataactgtatgtgtcagtctacaatgaattcaaaagaaaaaagttttaaaaagcaaagcaaagcattttgctattttgtactttcttcctctgcagactgccctactcacttccctggtgcaaagaggaaatggacagtctaatgtggcttctgcttaatagtctcttgtgtgcatagagaacctgttttttcccaattgtgtaagagttggttgttcttttctccatgaactattgtttgggctttgagtgagtgaggggagatttggtcctattctggagttacaagagggagaatctgacttatgtaggcaccattggtttccactgctgtccttaatgcccttctgaataagccaggtgattttctctgcacagtcctgaggctacatccactgagactggctctgtacaaagatgctaaacgccagacactccccagatacctctgtgccccctcccctattgatggagagcagaagagatatgagtctttcacggaggctgacatcacatgcagactttggcctcaagtctttgtcacttgccaaggacagaagaaataccgtgaactagaaagcttttgtgagtataaggaggagaaaaaaattagccagagttgcaagatgctttatgttgtttcaagtttgttctcatctctaaaggtaaactataggacccacctgctggggcaggtagatgagataatcctgcattagtgaactgtagcatctgactttcatagagaatggttttcttagtagaaattggggcgcaaaaaaatgaatgcagttatgggaactttgcgatgagatgcaaaatatctgggtagaaagcagataaattaccctcatgtatgtattttagtataaagtggacatgattactaggtaaaatgcacagaatttctcagttttcattgatggtatgaaatgtctcacactcaaatgtcagtaagggccagaagaaaatgtaaatataaggagttagtggataaacaataatagaaagtatggggcattgtcaataaactggagatcttggattcaatatgaatgttttcaaattcaaatttttaaacattgtgatggctggataatcacatctgaccacagatggtcagcagctgcttcaatataagttgtgcttggcttttctacatcatgaacccggaaattaagcttttctgtatataacaaaagcacaaatatcaatggcgtaaacaagattaggtcacctgcttctcgttaggatgtagaaagacatgaaaactttcctcctgtggtgatgacaagaatgaaccacataagaatcgtacgttcatggggctttcaaagattggaagatgtaaggaagctctgatgaactgaattgtagagggcgcgccctctagatgagccgagaccctggagctctctggggcaagtgcctgaatgagttcaggtgggaaaagtagcagctgcctacaggcaggaggctttgcagggttaagaaggagcatcctgcgtcaggggcaacatgtggctctggaggagttccaaatgcaaatatccatctctcagcccaacaactctcttccttacctggaattttgctgggaaagtggcattggagaaggggttggtagcagggagaatacagacagccttacacatctctgtgaggcttgggttctggagccctgcagaaggtgaacctaaaggtgaatccaaactgtctgaaacagtagccactccccagcttccaaacatgaagaaaaggtaagaatcctttaattatagcaatgcaagaggctggggttgggctaccagagtttcttacattagatgtaaagtggtatgatatgaattcaagatagagattgccagactggataaaaaagcaagaccaaaccatacagtatttacaaagatacactttaaatatgacacagatacattgaaagtaaatggatggaaaaggaaaaacatggtaatgtccagactcaatgtgagagggaactcacacagaggtgtggctgattttggcattgggaggtgtgactcattggcattgggaggcatgggccattggcactgggaggtatggtccattggtactggaaggcatggcccattaggactgggagttattgaacattgggactgggaggtacggctcaatggcactgggaagcatggaccattggtgggaaccatggctcactgcactgggagatgtggaccattggctgggaggtgcagctcattgccctgggaggtgtggaccattgcacgaggaagcatggaccattgcactgggaggtgcagctcattgccctgggaggtgtggaccactgcactgggaggtgtggccactgcactgggaggtgtggactattgccctgggaggtgcggaccatagcactgggaggtgcaggttattgccctgggaggcatggatccttgaactgggatgcgtggaccattgcagtgggaggtgtgggctactgggggccatgtggcatttgagttatggcagaatgggtctgggaaagagaattctgggctaagagagtcttccgttctttcttgtttcctcctctggaaatggctacctcttcttcctcaaaggaagctgaggaatgtctgcagcaggcaggctgtgtggggacttctagaccacaaaggcctgtctctgtgacagcttaggcctggtggggtgttcatggctgtgaacaccccggagagaacatggctgtggtctttaccagccctccattcctcttcccctcatagatctgtgagagaaaaggaaaatggatgtgttccttcgttttaggtagaagggctttgaggactggagaacgcctagggagaaaggggtgatcaaaatataccgttgttccaggatgtaattataaaaaactgggctccaaatatgaattcaggaatacttggtccccgtgccaatgcagccaagcccctgcacggtgtgggagcaactcctggggttggtgggaggcctggctgatgcatgatgggtctgaaaaccgctcaggctttgccaggtatgtgtcaggcactgatggcggcgatcggaccggcctaggttggcttagcgcgccctctagtgggagaaggtctaaagagcaaaatgtgagcatccttgccacagggcagaaatgatgctgaacgtgcacgccacatcaaaggacatacgtgcttaagggacttgtgcttaacaattactgtgattagtccgttctcacgctgctctaaggacacacccgagactgggtaatttataaaggtgttttaatagactcacaattccacatggctggggagccctcacaatcatggctgaaggcgaagaagcaaaggcacgtcttatatggtgtgtgcaggggaactgccctttataaaaccatccgatctcgtgagacttattcactatcacgagaacagcacgggaaaaacccacccccatggttcaattacctcccactgggtccctcccatgacatgtggggattgtgagagcaacaattcaagatgagatttgggtggagatagagcaaaaccatatcagtcaccatcttaaattgttaatacattggaatttgtttatgtctgttgtaaaaaaggccagtcgcttagctatttcatggcggttttgaggaattaccaccataacttatgggagagtgttttggtaaatggttacataagtatgaggaattttaattttttcattagaaataatgtgtggaatttataggacaatttattaagaagcttaaatgtatgtatggtcgttgattaatctaggtccatttctctcctagagagctgtcaatagagattgagtgtgtggtaaggcttcctcctcggtgggccttttagtgataggatggtcaagtgaggaagggctgtgctcctgcggctcctaattctgaattacatttattgggccatgcagtctggtttagtgcctgagtttatgtatgggaaatgaattccatttctacatgctgggtccttatcagagcagaaaaaagaacccacgctatgcagatacataaatgtcacccacatgaacaaggcactgtcttcagtatggcatgaagggggcagtgatgaatgggcagctggagaggggagcgtgttcagatgagacaggctggtgcagacatctggggtcaaccacagcagacactaaaatgcagtggggccgtggtgagggggatggaggggatgtgggaggtgagtgggagctgagggaagaggagtggctcagaatgcagtggggggtctgcgagaggaccagagagggaggaagcctctccttgggaagagttgggggcaggtcaggagaggttccaggtagagtcagaggtggctgggctggggtggtgaaagccacccttatcctccctgtgactcttagggtcattgcactgcttttctgcttccagatgagatggagtagcagggacggcgtttatcctttcacctgacataattaacacaggacaaaatagatgaggaaaaaaacaacaaagcgaaactgttgccatcagacagcgcagagctgtggtccctgagagggagagacagacaagaggagtgctaggatttccccagagggtgtggcctggacactttccaagctgtggcccatggatgtggctgctgtcgtggtggggtccctccggggaaatcactttgtcagtgaacagcaacatccttttctgatttttctagtaccacgcattgttttctcccattgtccaacaaaggaggcaagaatgcagtgtgccgcattcctcctgcagcagcgctccggtggcgtaccttaacctcgcttttgttttttcatgtgttggctgagtcagtgagtgtgctgtggtggacctctgccatttgtagctcctcaaatcttcagcaccctcttcacagtttgatagttccccacagtgtacctcctgccttctaatgagtctccaaatattccatttcacagccatccttgtttttgaggtgcaaacatatgatttaggtccagggatcataggcacccactcaaggctttgatcccaaacagttcccatggctggggcagagtgcggtggaggggcaggggcaggggctgacagctgtggcagaggcttcctgattcagctgcctccagatggggccagagcggctgcccctcactgcattagatctatggtatggcactgggggtctctttcttcagcattcgatttggtatgttatcttttttttttctttgatcagcttttcattatctctattcacaagtcgttataatattgctatttatcagtttaatgtaacacatatgataaaaacagatgataaaaagtatcatattaacaatgagaacattattggctgggtgcagtggttcacgcctgtaatcccagcactttgggaggccgaggagggcggatcacctgaggtcaggagtttgagaccagcctgaccaacatggagaaaccctgtctctactaaaaatacaaaattagccaggtgtggtggcacatgcctgtaattccagctgctagggagggtgaaacaggagaatcgcttgaacctgggaggcggaggttgcggtgagctgagatcgcgccattgcactccagcctgggcaataagagtgaaactccgtctcaaaaaaaaaaaaaaaaaaaaagagaacattattttacacaacccatttactgaatatgcagcctcttgcaacaataacatagtggacccaactctaccctctgaatggaccacttttatgattctcctaaaaagttttgagttggatatagtttcttgttgcttctctctgtgatccgagacttaagaatgagtctctggaaacgcagcaattggaaccagacctccccaggatcaaagaggacaggagtgggagaaaggacgcaggacacgactcccaccgtctccagcgctgcgccgtatgcttgacctcagagcatgcaggcactcaatgtcaagtgtgcagccacgtctatatcctgcatctcaagtgctcacaactgtgacaattagcagatatgggagagaggaggcatatcatggaggaatgagtcagtcccaaaaattacatgaacatttctgaaatttcaataccaagggttaacttctaaagtactagtgtataaacagaagccatatagctagccatgaactgaaatgcatgtaccatacagtgaaggagctcctgtgcatacaaaaccacccacgtctcatttatctctaattttaaaataactcattcccttgctggatatgcaagtgagtggtggagaaagaggtctatctgcaaggctggcgggggttaaggatttcattgcttccaaaagacgtgagcaagagaactttattactcactgaaggggattcttccttctcagccaagatggtcccatttaaatcacttttgaatttcctttcaagcttcaattgtgcaaattctagttgtggttgaggatcgtccccaacagctttttgagttattccttggactcttcctttttctactatgttttcatgaataattctagaatccatatttatatccagcccaaggcttctttcctatagaggtgtcgttgagttgtgagcttcaaagatctgatcatactgtttaaaagcaataggcttgggagtccagatgtcagcttctcagatccattttcacagtctgatggtgtctgctagcaattatcagtgcctgacccagaagcggtctattgcacctcagcttggaggaaaaagtgaaggcacatgcagtctgggaaaaaaagagaaaggaaggaaaaggcaggcaggcaggcaggcaggcaggaaggaaggagagaaaaagaaaggtggtaggtttctatgtactgacttggatttgtgtactgtgttccccaggcaattctaatccggactgcattcccctcaatgtctctaaagctgtcacatttgtaaatgcttactgcagaattttcttttttttcttttctttctttttttttttttttttctgagacggagtctcactctgttgcccaggctggaatgcagtggtgtaatctcagctcactgcaacctccgcccgtgggttcaagtgattcttctgtctcagcctcccgagtagctgggattacaggtacctgccactgcacctggctaatttttgtatttttttaatagagacggggtttcaccatcttggccaggctggtcttgaactcatgacctcgtgatccacctgcctctgcctcctgaagtgttgggattataggcatgagccaccgcgcccggcctgaggaattttcttaaatgaatttttaagttgtttcatatcaaaaaggtcagcatcttcacctggtcctttactcatctgaaaagcatcccaaactttcttgtgctgatgaaattgagtataaactgtgtctcaaagggctgcgtcatagggatttgcatgcttctcacacagcagaaccaagtgctgaatgagagagtcctttctctgccggaaatttaaagtctgcagttgattttcagacaaaaaatcccaggctttaggattgttgtcatttccgtcatggggatcctctttctctcttttctttctttctttctttctttctttctttctttctttctttctttctttctttctttctttctttctttcctttctttctctctctctctcttttctttctctttctctctttatttctctctttctttcctttctctttctttctttctttctctctttcttttctttctctctttctctctttatttctctctctctctttctctctgtctctctctctttctgcctttcttgcctttcttgcctgcctgcctgcctgccagcttgcctgcttgcttgcttgcttgcttgcttgcttgcttgctttctttctttctttctttctttctttctttctttctttctttcttttcttttcttttcttttcttttcttttctttcgacagggtcttgttctgtcactcagcctggagtgcagtggtgtgtgatctcagctcactgcaacctcgaccttccgggctctatcgatcctctcacctcagcctcctgagtagttgggtctacagcatgtgccaccacgcctggctaattttattttttgtagagatggggtctcactatgttgcccagtctggccttgaactcctgggctcaaatgatcttcctgccttggcctcccaaagtgctgggattacaggagtgagccatcacacccagccatgaggatgtttgagatgatcctcttaataaactcaacaacagtctcatccatctctctgtcatggcccacgtcttcagctacctctctcctcctgcatgctatctttgtcctataataaatcgttcactcctgaaacctggtagaggggattctgttgtctataacccccaccagtgcatttctatctaacggttaggaaaacctccttggctgggcacagtagctctcacctataatctcagcactttggaaggccgaggcaggcagatcacctgaggccgggagttcgagacgagtctggccaacatggtgaaaccttgtctctactaaaaatacaaaaaaatttagttggctgtggtggtgtgtgtctgtagtcccagctacttgggaggctgaggcaggagaattgcttgaacctgggaggtggaggttgcagtgagccgagatcacaccattgcactccagcctgggtgacagagtgagactctgtctcaaaaaaaaaaaagaaaagaaaagaaaggaaagctcccaactaaacactcaatggcctgctcataacaggagacacaggggaggtagtccagggtgggcgagtcagccgttcagcagcatcgtgaagaagccagttccttccaccttctactcattgttgtgcggcttcttcccctttgcgatctggtgctgcattccatctctagtcttcgggcatcactacttttccctgtggtgctcaacaggccatacagggcagctctgatgttggccaagtggaactgatgtggtcaggagacacaaatccattgagaggaggcagcttctccttggaagcagaatctccctttttatatccatgagaaacagccaggagagcaggaagccaagggctttctccttttctgttgcatgccagcgccctctttggctatgagcagcaggtctctctcccttcaccactgcatttggatgagactcagaggctgcttttgctgtcatctgtttggcttacttggtaagtttctgtgatttgaggcttgtcaccacttgtagagtttttgcttgatcgtgtgttgtttgtccagctttggttaaggccgcttaaaaccctgacctttggagactttgtgtgcaggattcctatttcatcattgtcgtgttttgtcgcaaagtcaggtttgcatcttggagagctttctggtcccccttcctgagttttgtgcccagttttgtggatgagtccatcataaatcttgtggatgaaatcttccaggtgcttctggacttttctgttcttttgcttcgcctgtgtagtgagagggagaagtccaacattaaatgagccctatttttacccaacgtctctttctccctgaccactctgtgtaaaatgcaatcataactcctccttcctgaccagcacttctagtcctctttatcctattttttctttctccatagcgcttatcaccctttcctatgccatctctgcctccagatctggaatataaagtcctcagtaggaaatacctttatctcttttgttcaatgaggtattctaattgctcagaatggtacctgacacatattaggtgcccaataaatagtttgtgaataaatgagtgaataaatactcaggatttttaacaaaagccaccaaagaaaacatgcttaatttattcaggaggtggaaatcttgggtgggatgaattccttatgagacctgcgagaagcgcaggtgatagtttgtgtgtgtgttcgttgtgcatttttattgatataaaacagaagcactggaaagtgtgggaagtgcgcatgtcatgaggatgcaggcccttggctggcttgtttatttcaggggtggttaggcattgtcgccctgggtggaggggtcagcgacgagccctctgaggccatcctgtgacatcccctgggcacctcctagtgtttgtcattcccgacgccccagggccagtgtccttggccttggagatctcaggctctgctggtttccccacctccctggctgtccctttttagtcctttcccacctcctgaccagacactgaacatccttggggctggtctccttcatttcttgctatattctttttttttaaagacggaatctcgctctgtcacccaggctggagtgcagtggcatgatatcggctcactgcaacctccgcctcctgggttcaagtaagtctcctggctcagcctcccaagtaactgggactacaggcatgagccaccatgcccggcaaatttttgtattttttagtagagacagggtttcgccatattggccagggtggtctcgaactcctgatctcaagtgatcctcctggctcagcctcccaaagtgttgggattatagacgtgagccaccgcgcccggccactatattctctttctattcaatttcattcttccctgtgcctctgcttaccatggggcacccacttgcagaggatgcctgattccatgccctggctccctccttggtggcctcatgcatctcaaactcaatatacccaatgctgtgctcagaccttccagctcaaatgcgctctgtctcagacatgctgcaaccatcctcctgggagttgacacctccccaccgtatcccctcacatccagtccctcagcatgttcccttgatcctaacttctaaagtgtccttgaacctactcacttctacctcccatgtgcccaccagacccagccccaaccacttttcgctggggtaacctcagtagaatttacactggtctcccttcattctctcacgcacacgacaaaccattctgtaccctgaagctggtatggtttttgaaaagctcaaatttgattgtgtctttaatgagttcccattgctctgaggtcagtgtggcatctttcatggggaaggtcatggccagcccccttccccttctcttcctatgttccagccaccatgacctgctgtccagtggtcatgagctgagtccctcatacccaaggcttttccagatgctttttctctgctggaacactgttcttgccttgcgttgctagcaaagatccccatgttcattaagcgcctcttaaatgtgacctctccagggaagcctcctccactcccattgcccattgccctggctcagtcagaccactctgtgtcttccttgttggtgctctctcctcttgtcattaaatcgctccatgtttaatgtctgtatcctccacttgactgtatgctctacaagggcagggtctaggctggcttggatgttatgctgctgaatctacagggcgaagcataggaggtgctcaataaactgaatagattttgaatagatgttcactgagggtaatactgaggagtggggttgttctcaatccttactgtagactccaaatgccagtactgttgggcgttgcttcctctgaaacactccttgaagctctgagtctcctttggatggttttacccaactccactcgtgcctccatcccttgctgcctctccagacatttgccttccttgtcattttcaggccgtcagctacagtgactgggaatgtgtgccacttggctctcacactcgcctctcactgtcgtttttctctcacgggagtttatcatctattcttctcatttccttgcctttctctctgcagcaccgataaatcatcagtttcacctgaacttcagaaagaagccattccttaattttggcagaagcacgatggagtagaaagtgaccaagtagactgacttctgatcatgtctctattgtgacatgccttcatgagctcccattgttcttggggttaaggcctttaatatatgttacaaggttggaatcactctggggaaatggccgaaactccctgagctttgtttcctcaagaggaatgtgaggtggattggattaaattccacctacaaccatttccatctcttacatttccagaatttgtcccagaatcatagaagcaaaccttgttcagagaggccatatccagctttgcaaaataaaaaaaaaagtcactgtgctggtgagatgggcctcaatcctggtcacatttctctcttctctccagatatctatgcttcctccctctcctgcctccccagaatataaacagctccctgagggttgaggatgttccttcgtcccactcccaacctgtcacccccaacttccagatttctttaaaagtcaaagagaaaggaaattttcaggaaggagatcatgtctaagagctttttattagtctcatcttccaatttcctgtagactcaagcttctttctttctgtcgtgcggggtttaatatccagtggctgtttgacaacagcaccaggaaatggaatttccatcctgattctgcctggaaccttgggcaaagtgcccaaaccttctgcctcactctcctcctgggagtaacagtccccaccctacagccttctggggcaagcaacagagacctaatatgaaaatggaaccagagagttctgatggatgtaaagtcctcaataaatgcatgcaggtattatttgttaatttttgccataggcaggctgcagcccccaggcaaactctgagtagaaggagcctataaaaacaagcctcctgcttctctctctctctctcatttttttttttttaattttttttttagacggagtcttcctctgtcgcccaggctggagtgcagtggtgcgatctcggctcactgcaaactccgcctcccgggttcatgccattctcctgcctcagtctcctgagtagctgggactacaggcgcccgccaccatgcccgactaattttttgtatttttagtagagacggggtttcatcgtgttagccaggatggtctcgatctcctaacctcgtgatccgctctcctcagcctcccaaagtgctgggattacaggcatgagccaccacgcccagccgcctcctgcttctctcttgaagcctgggttctgctctggtgtctccccagctcattgccggttgacggcacattgggctccctgtcagtcaggttggccacgtgaggaggagtcaatgaggcactgcttcctgccaagctgaggctgcccttcttataataaggaggtgagcctgtctcagggaaggttcttttcctaaatttcaggtgggattctaaacaggacaccactgatttttttaaaaatgaacctatcaagacatgcattttcatgggtgtaatcctgtttgaagtggtcacatttggggtttttatgtacttgctcctattactggtgaaacttctgtgaatgggcttcagatcatgaacagcctcagtggtggcagagtctcatgatttcaagttaccttatagttgagaaatagccccgcagggtaggtgatggcgtactccccacttgccattctatctggaacccggaaggtggtcaatccatattcactgaaatgaaccaagaaatgagactgtggctataaggttgaggatgttcatttgcttgtgaagcttctaaacaagatcttccaaacagttaagagaacacttggatatctttatgatggtgtgtttgctttgaaaaataaacatgaaagagaaccattatgttatagctccgctttctagtgagtaccccgtcaaggcatcatatccctctgtgtagcaatggaaaggcatttaacccaatgattgaacctctctgtgcctcagtttcctcatctctaaaataataatagaacctagctcatataactgttaagggggatcaaaggaggtaaaatgttgtgacaaaagttgcataacacagtggagtgtatttcattcattcccaagtctgaacttatgtgtagaataatgccacaatctatggccctgtgtcctgaaatgcccttcctccaggcccttttggagcaagagctccaaggggctgttccctcagataataacctaggtgattggaaaccttgactagggagcacagacctggaggtcggttccagtgtgggacagttggtcatatttcccactcaccctctgccatgcaaagtgggtgaggcagtggctctggccagttcattggcaggtggcaaaaccttgtctagtctttggcattgggcatgtgataccatcgatggccagtaggtggcacaagttgtccatcactgccgccagctttgctccattgggtgctttctcagaaggggaagatctatttctaatccagtcctggctttatggcaatgcttaatcacatggaagggaacatgcaataactactggtatttctgtaaacatgcatgctaagaatcagctgccatttggaaatgaggatggagggaacactcagtgagaggtctcctgaggacaatctaaaaaaggaaaaccttgagggttttaaaattttagagccagttaacctttgtgactcatggagagaaacgtttagaacccagaaggacaatgagaatacatcctgtggattgtaacctggtccaaggtccaccttgccctctccaccttccttcagctgtgaagtttaggaaggagagacaagatccccttgcatggagtcagcttacccacttcatgacccccagcagggccgggctgcaccttctgggctgtttgcttaattttttattcttttgtcctggcaagttgcctgcttcttgggtttgtcgtttccctggaggaaagtttatttgaatctcattctacccttaataaaattggcaccagataaatacgaagcggatgaagagacacattgcagcaaaacaaaaagtggaacgtggtcaacaacagggcgatgaggactttaatacatgtgtacactttctaaataaaaaattttcattgtagtaaaatacacataacataaaatttaccatcttagccatttctaagtgtacagttcggtagtgtcaagtacgttcacactgttgggcagctaatctccaggactcttcatcttgtaaaacagaaactctctacccattacacaacagctccctgttcttctctcccccaacccctaacagccaccattctacttcctgtctctatgaacttgattactctagtgtcaaagaaaagaatcaaactctgtaagatatttgaagagatttattctgagccaaatatgagtgactgtggcccccgacacagccctcaggaggtcctgagaacatgtgcccaaggtggtcggggcgcagcttggttttatacattttagagaggcatgagacatcaatcaaatacatttaagaaatacagtggtttggttcagaaaggtgggacaactcaaaactgggtcggggggacttccagcttataggtaggttaaaaaatattctggtttacaattggctgagtttatctaaagacccgggaccaacggaaagaaatgtctgggttaagataaaggattatggagacccaagtttttattttgcagagaaagccttcaagtggtaggcttcagagggaacaggttttaaaatgtttcttatcagacttaaagtctgtgttgatgtcagtgctggagaggtatcatgaggcatgtctgacccctgctttccatcatggcctgaaacagtctctcaggttaaattttaaaagagccctggctgagaaggaagccctttcagatggttgcaggggcatggggggatgcttagaattttatttttggtttactctaggtacctcatataagtggaatcacactattttgtcttttagtgactgggatatttcagcataatgtccacaaagttcatccatgttgtagcatgtgtcagaatttccttcctgtttaagctgaataatattctattgcatgcgtgatggttaattttatgtgtcaacttgactaggttaaggggtgtccagatagctggtacaacattatctttgggtttgtccttgaggacgtttccagaagagatgagcatttgaattagtaggctgagtaaagaaggtccgccttcgccagtgggtgggcatcaacccatctgttgagggcccaagtagaataaaaaaggcagaggagggccgggcttggtggctcatgcctgtaatcccagcactttgggaggccaaggcaggcggatcacgaggtcaggagatcgagaccatcctggctaacacggtgaaaccctgtctctactaaaaatacaaaaaaaattatctgggcgtggtggcgggcgcctgtagtcccagctacttgagaggctgaggcaggagaatgacgtgaacccaggaggtggagcttgcagtgagctgagatcgcgtcactgtactccagcctgggcgacagagtaagactccgtctaaaaaaaaaaacgcagaggaggagcaaattctctctttctcttcttagctggagcatccatcttctcctgccctggggaattggagctcctggttctcgagctttctgacttggggactcatcacccttagccccgcaggttcccaggccttcagctgaacgttggtcactccaatggctcccctggttcccaggccttcagattcagcctgaacgacaccatggctttcctagttttccagcttgcagatggcatagggtgggcctctttggcccccttaattggatgagccaatgcctgtaataaatctcctcttatgtatctgtatatattctactggttttgtttttctggagaaccccgactaatagagtatgtacataccacattttgtttatccacccgttcaccaacagacactcaggctgctgccttctggccattgtgcataacactgccatgaacatggtgtaaaatgcctcttcaagaccctgcttccaactcctttgggtatatgcccagaagttgaattgcttgttcatgcagaatttatttttaattttttttgtgtggaacagccatactattttccatggtggttgcatcattttacatgtccatcaacagtgcacaagggttcccatttgtccacatccttgccaacatttgttattttctgtttttcttttttcttgatggtagccatcctaatgagtgtgagatggtgtgtggacacttcaagtttgctctttctagggctttttctggagtgggcaaggctccctgatcccttcctctgaaagtggtgttactgtaaaggtggcattttcctgctggtcatggtggcacgcgcctggaatcccagctactcgtgagactgaggtggaaggattgcttgagctgaggagtttgaggctgcagtgcactatgattgctcctggaaatagtcactgcactggagcctgggtgacatagtgagaccttgtctcaaaaccaaccaaccaaccaaccaacccacccagacatttccccttctgccctcccctcagagctctgcctagagagcctgctgagtgtgggtacttctgggttggtgtctccaccctaggaacccacttgagagtgactttatttggaacaatcttcagtcacaggaatcttctgggaagtcaccagaccattgctttgaagagtacacagcctcagaccctctggggacaggagcaaggcaggctgatttattaaccacgctgcgtcacccttttgccctagaggttagatggtcccaggagcccccctcgccaagacactcctcagagtgggggtaggagggtgggaagttctagatcctcagtctggccttcaaatattccattacattgccggggacatggcgcacccacatttatccaaaggacaggggtctccagaaatgtctgcccgcaatatcctttggttacctccaaaacattctcttgaagttgtttaactgccatacattgttgtgggccggccttttattcccagattcacttatttaaaaaaaaaaaaaaactctcgagcatctctgaagagagaggttatatggcagatgcaagtcagcagaaggcagagagctgagaatggtggggagagagacacagggctcacggtgtgacaagcttcttggtgagtggtcaagtgcgtaatggccaggtaggcggctggtgggatgtgctcaggcagaccagcgtctgagtcccaggctggtcactaatttgctctgcgtccttgggcaagctccttcctttctctgtgcctcagcttcctcatatactaaatgagggtagtgagagctagctcagagctgttgggaggtttaaatgagtggatgatgtaaatacaagtgtcaggaatagtgtaggtgctctttagtgttcacccactgctgtggtttgagtgtgtccaaagttcgtgtgttggaaacctaattcacaacaccaacagtgtttggatgggggaccttcaggaggtgattaggtcatgagggctctgccatcatcaatggattaatagtgttaccttaggagtgggttaatcattgagggagtggtttcttgattaatggataagttcagtcccctttctctattgctccctcctgctcttttgtccttctaccttcccccatgggatgacacagcaagaaagtccttgccagatgcagtctccttgaccttggacttcccagccttcagagctgtaagaaataattttttttgttttctttttaaaataaaccacctgtatgtggtattctgttacaggctaagatactttctttctccactagccacttgctcagtacaagttgagagaagagtgttgtgaagcccaagtttaggcagagaggagcaggttagggcaagtgagcaggcagggtttgtctctcacccacctgcatttagccaacagctaccagtggcagccactgggctggtggacatgttccctgccacggagagaggggagtggtccagctgcaaggctctagttctgggatctagtcttggtgacggaggatcctggaaccatctaacctctggggcaagagggtgacgccatgtggttaataaatcagcctgccttgctcctgtccccagagggtctgaggctgtctactcttcaaagcaatggtctggtgacatcccagaagattcctgtgactgaatattattccaaataaagtcactccctggcaaagggataagtccctacccaggagctgcccaaatttttttttgaaacggagtctcactctgtcacccaggctgcagtgcagtggtgcgatcttggctcactgcaacctctgcttcccaggttcaagtgattctcctgcttcagcctcccaagtagctgggactataggtgcccgccaccacacccagctaatttttgtatttttagtagagatggggtttccccatgttggccaggctggtctggaactcctgacctcaggtgatgtgcccacctcggcctcccaaagtcctgggattacaggcgtgagccactgtgcccgacctcctgcccagatttctattttattcttgcactcagctaacagcctggctgcccagaggcaggtacaacttattcaagagcaggagaattccaattttattatttaaaaaatcacataattaactgagtattacaagctttgagatgtttgttggttaataaagatgaatgggctatttgaggtaatggcttttaattaaatggaagctaataactttggtaagtttgtccgagtagtaatcttggctaacagtttgaagtttcgtacaataatcttggctaacaatttgtagcttgccttgcactgatttcatagcattcattgtttacaacacgcagaacacccactttacagatgggaaaacggaggctgaggctaagggcacaggaaggctgtggggggattgcagtccacagcagccccgggggtctcaagggcatattccttttaatcatggcttcccacacaacatgcatccctaattctgttcacctgacccctgactaaagctcagctttagggcaggagatttaaaatacaaactcattatatctgcaggtgtgggctgcagggagggcttggagatgtagaatcctcctttgctgccatgtagagagaggaaagactgcatgcaggcccagctctgctactcacggcctatacaaccctgcacactttatcccagagcttaaatcttttcccttcttgcagctcttcttctgttaagggacctagagcaggacataatcatctgttcttcttatggaggggctaaggaacaagaaaaatggtaaggagcaaaaaatggggccaggtcatttgacaaggaaccctgggaaatgcaaaagttgtatattctttgctgagttggagcattagtgacctttctctcttttcttgtgaatttacaggagttgcaaaggcccagcacctccctgtggcttttaaaaccaggtatgtgggcaatgctcagcagagactgaggaccatggccggggtgccctgcagccctttcatgccgggcagctgcagcctttaatttgggggctattgtggtattgttggtattattcagggtttgggcttcaagagaacctgtgatgatttctttgttatttcacagaaattggtctgaacggttggcatgtaatgcggtggcactggttctcctgtgtttgcccaaaaccttgccaggagaaccaggcagtggacgggtgtgtggtcagtgtggtgacctgcaaacaccactgtccacacctcatgctcttgctcaagaattttcccaggctccgtgcatgtgtaaatttgcaaaaataacaaagccaaccttcattgtttgttctctaaataagaagaagcttcgtggtttgtgttcgagtgaaacagcaagggagaattttgatcctgtggaatctggccagaccttacagggttgaggggtctctgcactcacatttgccgtgttcctgtccctctgcctctcacctttgaatgcctccctggggcagatgctcccggctcctactcctcggatcctttgtgtaatttctcacaaatttctagagctcacatggaccttcctttcatagtccaggaacacacagggttgatcctcgaggcctgtgcctctctccgggcacccgtaacaccctgctccatgtttgcttcaccttggagtaatcaccttgcactcaccccattgtctttgggggcttatgttttgtgggtgatagagtgcatcatctatgaggtaaaatcttttatgtgtgtttgcttattccgggatgcactggtggccaggctgtgctcattctggctcactgagggtgtgttatcatcctgccatggaccaccctcttctagaaggaacagaacatcagggtctccctcccagccccctgttccaggtaaccacagcgtactgcaggaacaaaggtgtagactgaaagtaagttaaaggacagggctgaggcctatagactgatttttcggagtaaggaggtgggcccttttgaaaatattgagatataatttatataagataaaatttacggctgggctaggtggctcacacctgtatttctagcactttgggaggtcgaggtgggtggatcacctgaggtcgggagtttgagaccagccccacacaaaaccctgtctctattaaaaatacaaaaattagccgggcgtggtggcacgtgcctgtaatcccagctacttgggaggctgaggcaggagaattgcttgaagccgggaggcagaggttgcagtgagccgagatagcgccattgcactccagcctgggtgacaagtgcgagcgaaactgcgtctccaaaaaaaaaaaaaaaaaaaaaaaaaagataaaatttacctattttaagtgcacacaatgaattttggtaactgtatgcatttgtataaccacccgacaatgagatacagaacacttcatcacccccaatagttccctcaagcctctttgcagtttctcccctccctttggcctcagcaaccagtctgtgagtctagttttgcctttctagtctttcatgttaatggaatcaagaagtgtgtactcttttatgtctggcttcttgcattcagcatattttggagccttgtccgtgtcactgtgtgatttctctttattactgagtagtaatgcattgtacagaggtagcacaatttggtttttcatttaccagttggtgaatattcgagttgtttccagttttgggcaattaggaataaagttgctataaacattaatgtacaggactttgtggggagttctattttcatttctctttggttcatattcaggagtgggtttgctaggtcacaggatagacatatgttaaaactttgtaagatactgcaaaactgttttccaaggtggctataccatttgtattcaaaatcaacacttttagcctagagcatataactggccttcctgaaatccatggatatctatctgtgcaatggttttagagacattttattgcctcccacatgtaattaagttacttggcttttaggcaaaagatgataccatgtctatggatgagatgactctagttttgaactctgggttttgcagaagagtttgcattatcctcctcctgaggaaagcagatacatccgccacgatgcatgtgagtcaggtcttctgcgtgtcctctgaatcaggttcgcatgtgtgcctctaatggcagtttcgagttcatcctgtgttgagataatgcctgaaggcgagaggaaaaaatatctgtggttgtcaaatcgggtggaaagtgattaatcatggagacatttacggcatgctgaactgtttcgtttcctgacctttgtcccacgtgcgttaggggcaggcggggtcaagtttaaatccaagatgacaagtgtctgaggctaaggaaggtttctgctgaatacttggcttagagtcaatggctccatgtttcacacctggtgaaaaccgactcgcaattgaaagaaacagcatgggagtgtcaaacacttgctgacttggccttgggctagagcttcttgcgagggttttagaactgacacaccctttggatgtgctgggggcatctggtttttggtgcctgagtcacaaatcctggaatacatttgcccacagtgtttccataccattggaagtgcattatggctgcttctcttagagtcctttaacctcttcctcaagagccagctttgtcaacttgatgtatctcatggcaggcatggactcatgcctgtgtgtcccattgtatccccagatcatgggatttgtgggattcagccagtgtcatttactaatcactaggtccagggccaagtttaggtgaggttcactccatctaagctgtgttttgggggagggagggtctctattttttcatttagagaagtgactagacactagaaaatgtcacagagtaaacgtatggactacagcttgttttctgaaaaggtttagggatcccgtgttagtattgaaagaccctttgaggcctcatcccctccacccagtgggcacacaggcctctgaccttcagcgccaagtctcccttgaggtcagcttctcttcatctttcacttcttttctcttcctttcacccctgctggttgcagcgacaaggtccctgccaactgcggtgtgcacactggcgggccttcacctcccttaaaatccagctctcgaaatgtctgcaagggagcagcctgcaatattacctaatttgtctttaatctggtattcctagaataatccagagaatagagtggcctactgtacacactggattactcaataaagaacatgatgggaaacggcagtatttttctgttttaaaataagtaggtttggagggagctgggaaactgcgggctttagttacaaaatgactataattgtgggagacgtattttctttgaatgttgaaacacattggacaggatatacaatttagaaataatttacagttagagaaaggccctttcatctgagagggggcacatcttctgattggaaaggatggtcccaggggatgagggatcgggccccaggtgagcttcatctttttctcttccaacttcagtgtggccaaacagagcggaaagtcatcacgtagaaggacaaagtctgtgtttttttgtttttgtttttgttttctctcatgagagaagcaggcaagtgctgcctgagaaggtgaaggctcacctgtggcaggcttgcttcaagctggctgcagactgaaggccacccagaggctttggtcaccaagggtggcatgatgggtggccttctccttgctcatgcagctctcaccagcaaatttctactgaatgcccactctgtgcagggtactgtgccaagcacgagggatgccaggacccggaagaaagaactctgttagagaaccacagctgatagctgccagtcagcagtaaaggttcaaagcttggcctggccaaggagctatcacggagggctctgtggaccagggtcttgtagtgggagtgtgtcagcagagtggaggggttggaggagtgagcccaggtatgcaggggtatggatgggccgagagccttgggcctggcctggctgaaggctgtcctgttgaggcactggcaagtgggcttgggaggcagacggatgaccagacacggccccacagagatcagcccaaagcgcttggacccagggcatctgggatggttcttgaggtgagcgcatgaagccttgttttagacacatacactagaggactccagcctccctgcaagccctcctcctctctctctcctcactgttgaggcgagtgctgtgtctgccttagattccttctgcaggcttctgtctgcctgccagcagatgcctctatgtctgtcagccctcagaatgtcaggcacatgcactacccactgtgtgtgtggggtgtgtgtgtgtgtgaacatgtcagatacccacacaggctctccactgttcagtgtgtctccagtctgggacctgggggtggaaatagtcaccgtctacatccatcttcttctgcttctctcttaggcatttccaattcaacatacaccagcctgaactctttatccacatccctttccagcatgctcttcctccagcccctactgaccccatcacaggaaaaagccattctgttcttccagttactcagggcgacagcctcggagtcatcatcgatgtctttttcctctcacacctgacacctgacctgtggccatcctgttgactctccccttgaaatacatccagaatccagccccttgtccccactccagcactcacagtcacattgcacctggtctggaccccagcaagtgctgccctgtgggactccctgcttctccccttgctccacactgtctattctctgtagcctttaagaacaactcaggtcatttcactgtcctgctcaaaaccatcaaatcgtttcccgtttccttcagaatgacattcacagtcctttccgtcacagctctgcgtggcctgtggtgcctctgtatcctcatctctgacttagtttactccaccccattctcctccttcaccagactcccaggcactccttcacgagcagcatgcacctgccccagagccttggcaccagctgctttccctacccagaacactctccttcccacatcttcacagccagctgtttcattccctccaagtcccttatcagagaggctttttcagtcactttgagtaaaacagaaacctaccttttcatcattcttgaccccttaactaaacttgcttgagtttttgttgttgttgtttgctcgttttttacttattaccacttgacatcacttttgtgggaatccccttgcttttatggaaatatgtaagagtaaagaacttcatcttattttccgattatccccaggtcctagaacagtgctggcatttggaagctgttcagtatttgctgaataaatgaaatgaattatgctgtgattcactgtgtgtttggaggtgtttggagggactggcatgggaggattggattctacggtggtaatagtgacatggcatgatgaaggcatggagtagaggggcggccacagaaatgcaaaggaaggatgactgagggagaggcctctagctcggttgttgcaggacagggatgcttgactggcagtgccttggatgactcgttataagagctgtactccagactcaggatatgctttaaccataggttttcagatttctcctggggtccagtcaactcccatgccagtcccttgttccatgatcccaggccctgctccaattccttaactcttattctgtaaccgtaacccaaatggctaagcctgaggttgcaggctgacctttagagaaaaagttgaactttctctttaaagctaagtgggaaaaaaacaatgacggataaaatgtaaagatgtacaaaggtaccagtttgtacctgggtgtttgaatttctttacattttgctgtcagttgtacatggccatttgaaatgagtaatttaatattctgctgatttttaaatacatagatcattttcatggcactacatagtaaatctgtgctttgcttgtctgctatctgtgtgtttaggttcacaccagttctggtcgtgaagctatagctcaggcattatcatggacttcctagaagctgccttgccagcaaggagcctaagaggtgttcagaaaaattatccaaaacttggaaataaggaaagaggatgactctatgtcctttaaagtccagatcagagcattgtctattagatccactcaaggattatttaaatctcaaggagaatgtaactttgcttcacatactgtttactagtaactggctgcctgtcaacttgtgggagataagctggatacaattttgtccagtacagatgcaaatgattcccttcccttcccttcccttcccttcccttcccttcccttcccttcccttcccttcccttcccttcccttcccttccctcccctcccctcccctcccctccccttcccctccctccctccctcattctctctttcttttcttttctctctttctttctttctttcttctttctttctttccttccttccttccttccttccttctttctttctttctttctttctttctttctttctttctttcttctttctttctttccttcctttctttctttctttctttctttctttctttctttctttctttctttctttctttcttctttccttccttccttccttccttccttctttctttctttctttctttctttctttctttctttctttctttctttctgtctttctttctgtctgtctgtctctctgtctctctctctctctctctcattctgtctctgtctcattctgtctctgtctctctctctctctcattctgtcacccaggctagagtgcagtggcatgatctcagctcattgcaacctctgccttccgggttcaagtgattctcctgcctcagcctcccaagtagctgggaccactggtgtgcaccaccacgcctggctaatttttgtatttttagtagaggtggggttctgttatgttgcccaggttggtcttgaattcctgagttcaagcaatccacccactttggcctcccaaagtgctgggattatagacatgagccaccgcatccagccagctcttttatgtttaaatcggccaagcgtgatcgatttccttcaggttcaaaagattacccaaacattacagttgtattgtgccatagaacattaaccagttttgtatgtaacttagcaaacttttttcagcattctttctgacatacgatacatctgtgttcctcaaatgctttgagaatcagcttttccatcctatgggttccctcagtaatgagttaaagaattgtgcttgctacctgtatgagggtatgagagccaagttcctaatattttgaaaatgatgttttgatggaggagataaaaagtctcctgtgttagctatataaacccaaacctacaaaatgatgtcaagtaccatagaatgtatacaaaagacataacctactcctcccaccaatttctattttattagcatgcatttctcaggaaagactgttcaaaaggtaaggagagaataccattctaccattctgccaattcaagttagaccagctatttctctttgcttattcacttcctgttttctcttaataaatttatttaaagacaatttattagagaaaaagttgtcttacaaatgcgaattgtaagttgtcttactgatgtgatccagcaatccgtcctggccggcaccctgccaggtctgtaattaagactgggggtttgctctgcaaggacacattctccacctttgtctggggggctctgtactcagtcttgcggtttgtctgtggagctgaggtgctggttgggaatcaggagacgtcagttccggtctcagcaaagctgctgcgaggtgcggggcagaggcctggtttacctggtataccacatgcccttgacttccctgtggtaggtgcccctgattccgctccagctcttgctttgcatgtaatttacactgaggttgcaaacaactgcttattcctgtgggacttagttttttccttagggccaatctgaaaaacttacctccttagttacatcctacggatttgcagacaaataggggaaagaaatggaagaaataagggaaaatgttatccaaagttggaaataatagaagattactctatgtgctttcgatgtcatactagaagaagccgctttaagtagcaccattattctgaatggagaaatctgtggttgctttagtcatggagactacatcacaactagggttttccttttatttttgagatgtgtgtgatgggggaggataggggtacagcattctagaaatggcctcattttgcatttccttaggtccaaagttaaaataactttctgttctaagaagctttaaaagtggttcatggaccaggcacggtggctcacgcctgtaatcccagcactttgggaggctgaggtgggcgtatcacctgaggtccagagattgagaccatcctggccaacatggtgaaaccccatctctactaaaaatacaaaaaaatttgctgggcatggtggcgtgtgcctgtagtccctgctacttgggaggctgaggcaggagaattgtttcaacccaggaggcagaggttgtagtgagccaagatcctgccacttcactccagcctggtgacagaactagactcagtctcaaaataaagtggttcatttctttctaaaatcattaattgaacattaaaaaacattggtaagaaaaattgaaccaagaaggttttgggttatactgtaggtcagtgagctttaagtttctgtgtctctgaagctacatggctggacgatagctgaagtcagtgccccgagtgaagcctgaagaggagctgatggatttttctggtggggaaggcctgtgactgcactcagagagagctgggccaggcggggtgaggcacggtcactctgagttcacagacccactctgatccttgaatgggtctgtcctgaaataatggggaatcctggaacatgctgctttgtgtagacgcctttctcctttgcaacttttaaaggtatttgtcccctgggtttcatttgaaatgcttttttcttcttcttcttttttttttttgccagatgctttcactaggagcagtatccagaaagctatgtttctaacctaccttgttgtttgcctcttgggcaaatgggtttgtttaccttattgactcagttcagtggaaaatattaccctgattgggatggagatggggctgctgttctgaaataactacgcaagtttacctgttcaggtgggacacagcttcttgtgttagtcacggatgaattttgaaaatttatacatagtgcaataaatgctggtttctttccccttcctcactccttcctggggcctatatgtgtgtatctctaacacacatacacacacacgcaggcacacacacactcatacacatgcacactcacacacaagaggatacgttgcatatacagctcaatgctacaaagaagcccttttaccagaagagcacacgggaactccgctgaagtttgacagggtgattgtcttgtggctactctaccctgaggccagagcacagtgagggcctccctcctgcccccagccacaccaaagagggggcaggggttcacagggagcaaaagaggagctttttgccatcaccatgagacggtgaccacaggggcctggctcgaaggtgagggtggggctggtgactggtgcctgtggattccagagtggttggcctacacagcctactgagaggtagagcacggtcctttgcgtccctgtggactccgagtgcctgccatggtttggaaggtccactgaaggctgagtgctcagcggcgttgccagccagctggatgcatgtaaacagcattgtgaatggagaacattctttcaccttattcttgcacattcttctcccctacttagcttcttatccttcctatctactcatctagctagcaatccctaaaattaaatcatttataaatgagtccgatgagggtctttttttgaaaactggatttagtgaataaggcagacccctgtttttggatagggctttgcctcttgttattaaggaggaataacttgttcccaacttggttggtgaccccagctgaggaggaacaagtggcagatgagtcccagggaagacccctagggggaatggctggaggtagctgtatcagggatgaaaagggtgggggtggtgatgaggggaacgcagcccttcatgcaaagaagtgggtgtttgaaatcagtgggtgactatttttttggcaatgtgggctccttaggtcatacacagtggccttagaaagccagccctgcctctcttccctcaactgatggtggatttgtgtaatgagatcaccgtcttcttgaaaaacacttccagggtagctcattacaaagcctcgcacagtgttcggagcagggcgagctgcaaggccccgggctttccattctgaaagagctgtgggtgtcggggtggctgccagctgtgagagctccgtgggtggggactctgtccctcaaagccacgcactcaggcttgcccattctagtgtctctgtgggagacaatcaatgtaatttactctattaatggaatgaaggattacaataataaaatctttttcaaggaatgcaaaaaagcatttatcaaaattcaatatccattcatggtaaaaactctcagcaaactaggaacagtaggaaacttccttaaaataataaaggcatttacaaaattcctgcaggttgcatcatgcttaatggtgaaagcctgaactatctcctaaacccatttactcctcctcagggaagacttccctgaccccatgtttaagtcaaacactcattatacattcccttaggaccagcctctcatccaaagaagtgatcataaatgcaatttaaaatgtatttgtggttgggcgcggtggctcatgcctgtaacccagcactttgggaggccgaggcaggtggatttcttgaggtcaggagttcaagaccagcctggacaacatggtgaaaccccatctctactaaaaatacaaaaatcagttgggtatagtggtgcgtgcctgtaatctcagctacctgggaggccaaggtggaaggatcacttgagtctgggaggtggaggctgcagttagccaagatcgtcccactgcactccagcctgggtgacagagtgagacttcgtctaaaaaaaaaaattatttctgccactatttgcttaatgtttgttttctggtgtaggcattcagctctgtgaataaaagcattctgctgatttctgctgccctgtatccagacggaaggaatgggtgagtgaatgacaggcacctgttctgtttacagtcagtaaagtaaacacaacactacacgtatgaactccaccggaaagatgaacacttatggtatatttggtgccactgtcccagggagagtagaagtacagggttttgttcttctgacttgagaaatttttgtgctagaagggccactgagggtcatccaggcctatcactgcccaccccaaatttataggtgaggtcactagggcctgagatctgaagcatgcatgacatcccgaatgaactacaaatcctaggtcagagttaacagtagtggtaactgcacaggatgagttggtgcagggtgacaagctcatgcgtggtagctattttgaatcaataccccgtaactaacctctgctgtttgaaacacctggcagagtgctgcaactcacccttgggcaaagccccactctctgaggctgtggtggggttcagggaatactaccccaaaatatggcagattggcattggagaaaacggcagaagcaggaaggcctctctcaccttctccttgcccttcttttcctgaagcaggccatgaaaccaagctgactttctcctggagcaaggcataaggtccttgtgtgagaggtgcccactctttacctggaggggaggaacatctttatctctgaagacacagggacgcagaagaaaagctgaacaaacaggccttgctgagttcccccttgtatataactaattagatcatactccctttgtccaatcacacttctccactactgtcgacttctccatcaaacttacaataaaaacacacaggtgtccctattccctatttctttatctttttctttctttctttctttctttttttttttttaagatggagtcttgttctgtcacccaggctggagtgcaatggcgtgatcttggctcgctgcaacctctgccttctgggctccagcaattctcccaccatagcctcccgagtagctgggattacaggtgcccgccatcatacccggctaatttttaaatttttgtagagacggtgtttcaccatgttggccaggctggtctcaaattcctgacctcacgtgatccacctgcctcagtctcctaaagtgctgggattgcatgcatgagccactgtgcccagcctctttggatcttttttcctgaggtgtcttatgttacataaaatttaaattaaataagtttgatgtttctcttgttaatctgtattttgccataggtgcctcagctatgaccctcgtaatgggtgaggaaaaaacacattttcttccctgcagctgcttggccacctgccttttgcttggattggcagaaatctggcttaatctggcttctccagtcctccatcacctggccaggaggtagcccttggtctaaccccttctcatgtttggaagcagactttccctttctttctaaggactggtaggcagctcctcatggatggagtgataactccagaatgtcttcgtgtgatggctgttggagtgggaagtgggctgggaggctgtgctggcatagactttgtgtaggattgagaagacaataactgccagtgtgaagatcaggcgggagttgggaagacagctgagagtggccaaggggaagccagagcctcttcaagtcatctctagatgggtgtgaaagggagagaagaggccaagaaaccatgagattaaaaggtggaggtgggggcatagagatcccagctgctctaggggaccctcccaggcaagtgctgtgtgtgtatgctcctccactgttccttctgcaatgcattccatctggctgctagatacggtaaagggaatgaaaggtgggaaaggcaaagggtgcatttaatccactcttcagctgtgaattctctagaggagagctagtccttgtgtttgttgatgcagctgcctctctcctgagacctgtaaaatgacttttttttttaaaggtaaaatcatgactcttacacaaatgtaaaatgaacacatgtcaaagattttatttagttcattaattaatgagggaaccagtaagatgctacaaccagcccaaaggagaattaaaaatgccacgcatagctaggacaataggaatgctgacatagaatttacaaatagatgcaaaattgatgatagccactggacagtctgtccacatgtccatggacaaggatagttggcattccatgggtcttttacaacttgcaaaccgaggaaagtttaggtcctcctttttccttgctgacctttcatgggtcagccctcatctggacatcaacactcctgagacatgtggtcactgcaataattgactgaaatcagtaaagacacaatttctccctctgctgctccgtgttcctgtctagagagttgttttcctctccaagtaaaagttgttaaagagcttaaagacaatgaagggcagagagagccaggatgtgaagacttttctgctgtactgtctttcacagatccatgttgcagctgggagcacggggaaacctggacacgcacttcaccaaaatgagacaactgtggcaggagacaggctaaggcgagtggggacaaatcaatgtgctggatgccctggtgtacctgtgacgaagaagcaggagctgggaagagagaggaaaaggaaatagacaagtgaataaataaataagagttcagaaaccccgtctccaccaaaaatacaagaaattaggtgggcatggtgctggcgcctgtagtcccagctattcgggaggctgaggcaggagaatgacgtgaacccaggaggtggagcttgcagtgagccgagattgtgccactgcactccagcctgggtgacagagcaagactccatctcaaaaaaaagagttcaaaggaagtgtagaagagttgagagaagaactctatttgcacattcactcttcagttcatttcctcattcattttctgaacagtgaatctggctctgtgctggatcctggagcataaagactaaattagctgcacaaagaccctgatcactaacatcctagtgggaaagacacactgtgtattaagctgagtaatcaccaccttcccaccatgtctgtatcctgatccctggaacatgtgaatattatcgtatatggcaaaatggactttgtagatgtgattaagttcaggatcttgagttggagagattactctgcattggcctaatgtaatcacaggggttttcataaggaggaggcaggtgatcagcataggagaaggcaatgtgattatggaagtaaatgtgggagtgatgcagctacaaactgaggaaagctggcagctctggaaactggaagaggcaagggacagattctctgctggagccttccaaaggagccaaccctctgacaccttgctttcagccttgaaagacacattttggacttctgaccaccaggactgtaagagaatagatttgtgttgtttgaagccactgagtttgtggtaattgctataggagtcataggaaactaacatatatgctgaacaattgcatggtcgcatgattgcaatgtagagtgttttgaggaaggaaattaaggcagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggatgatggaggctggtggcaggggcattaatgtgtggccatggtggtctgtgtgatacggtgaaaatgcaaaggagatgaactcccaagacttttgggagacatttataggaagatgggtgctaaataaatccaaggcagtcttttcagacagagggcttgataccactaattaggcagcttggatgagtggcaccatggaactggctggtggttttcttgtgaaaatagacacaaactcccttctctccatgttcttagaagatgtgaatttagaggtctccacattgcctgacaaagtctgttttaactgggtaaaataaaaaaaaaattaccattgtattgctcctgaaccttgcttaaaattccctttaaagatctacaaagggttttgctcatttgtacaatcttaaaggtcacaaaattagaagcttagcagccacatgccaactgcacacagcatttgaaatctttgacacagaccgttccagaagtcacaactggcaaagctgcacttcttgtgacactcagtagcctgcacacccatctcctggcttgtaagcatatgcctttttgtccagccagctgaggtacttggttcctgattgttttcttgtttgttttttaatgctcagatattctcatgtggtgaatatttgtgagccaaattacttggcaggagcgtttgatgccatggccaaatggggagcccagagtcagcatctttttaaagctaactcttacttgccagctcctctttctgcccacatactcgccccgtaccaggcccagtggctgttgcacagacaaacaccaagcagtcctgcaaaccccatttgcttccttctgggcttgatgctgcctgggagtgggcttctccctgggtggtatgtaggagttttccttacattttcatttcttatcagcttaccatttgcaactgatgcaggacaggcaagaccccaaactggggcttagcccaggaggattcttggctttgcccaggagagaattcaagcacaagtggtggtgttagacagcaacttttattgaggcagcagcagctgtactgctccctgtggagcagggctaccccacaggcagtgtgcccagagtagcagctcagggacagttcagcagtcatatttgtacccacttttaattacatgcaagttaaaaggcagttgatgcaggcatttctaggaaaaaggtggtaacttccgggtcattgggttactgccatagaaaggggtggtaactctcaggtgttgccacggcgatggtaaactgacatggcacactggtgggcatgtcttatggaaagctacttctgccctggccctgtttcagctagctctcaatttggtccagtgtctgagcccagcctctggagttgagtcccgccccctacctcactatcttggttctatttggagatgccctgaaaggctgtgtccagtcccacagtgagtgaggaatctatgctgaggttcctttggaggtgaattttgaatgacgtataacccagtacagaggaaaagtccagaactgagggatgcaggctaatattaaagactcatagttttgggggctgtctgtccaaaggctcatgcatgggcagaaagagttcacctgacctgtgctgtgggaagtttgctgtaaacattctgataaacatttaactttagtccctttcagtaccagtgccatgccctgcagtgttcactaagcgcccacaggcatctgctctctgtgacctgctcatatgacgagctaaagtcgagcatgcttcattcacagccaggcctcctccttctttgttggcctgagtgtgttgctgaccattcatgggtcagccccgacctggacatcaacactcctgagaaatgtggcaactgcaataattgactgaaatcagtctctccctgtttgctggtccatgttcttgtctagagagttgttttcttctccaagaataagaaggtggaatcgatttttccaccttttgttcccctcaccccagtgatgatgaggcaccaggagggaattttctgactttctgcaggcatttatgttctgcttcacatcatcatatttattcctttaatgtaggagaaccttaaatgaagcttgttggaaataggccatcctccataacctgggtttgttggagcccatgtatagaaatgatttcttggcaactctagttctcttgagcatgtgtgctatggttaaagaggcagaagggcacaagaattttagcaccctgaggactgaaaaccttccatagaaccagcatacatattgttttataaataaggagtattcttggggtatagttgtttgcaaagaaagggagctccttaagatttatgacccagctcacaataaccagatgacctgaatcaagggtgtatgtcaggaacaggatcctggaggggtcaatgacagtgtccatctgtggcctcaaagagcccgttcccaactctcctgccttttgacagaaggtctgtctggttatggctttaggaagatagatgacttctgtatagtcacaggaagagtctgcgtgcctggagctgtgggctggaaaggaggtgagagatgctggcctctccaaggcctcgtccacgtgccccatctccagacaggagcagccagggctccgttaggctgcaaacaatggaaaacctgaatagcagaggcttaaaaaacatgtggtttgcttgtctcacctgaaagaagtctgaaattgggaagtccagggctgggtcagaggttcagagatgctggggttgaggcctagatggctttttggccttttccccaggaaaaaacagaatcaatcagaaggtggctgatgtaggtcaggtgggctggggctggaggggatggtaggctgtgagtctggcgctccctcttgctggtgtggggatgggtaccaggagggcttctctcctccaccttgctctgttgctctgttgctctgttgcccaggcacccattgccaagaagccagactggaattcccaatgggatggggcagtcccaaggcacatggaatctttggtgggacttatacaccctgtactcctgtgagctcctcagtcactctggtcaaaaactctaatattgttccttttaacacagtcatcacccaaaaccctgttaaacacccaaatgcacctggggcaacccttgaccttatggagcccactttctttgcaaacaacacagatgttgagatgaagcaggaaggagtggttacataggaggatccagaatccccaaccccagggagttcgatatgggaaaaatgcctctgagtagggcggagggatgctcagagggctgcagggtcctgggaagtggctgtgtctcaaagtgtgctccatattcatacccgtctttccccactgcttttatttgcttcgcttttgaatctgtgattcaccttctttggtctcacctcttcctcgggccctttggttaagggcaggctgattactgcatatggctgtgccccagccctctgctttacccagcgattaaggagaagcccacaccaattcaacaaggcttgcattttaggagcagacaaaaatcttagacccagaagccaggtgtgcagaaaatgcatgttggcttccctttagcgttatctaatttcccaggctcaattctgtctgggtaaaggaacattattcttggttagctgaagtcccctgcttttcctgcagatgtgtctgatgctgggggctggcattgctccccttgggggctgggagatgctctcctttctggtctttggttgtcagagcctgctgttcactgctgttgtctcttgttctgactccaccccagctctgcttcaatcctactctctccaggccacagccacccactgggacctcccatgaagctcttgggagctctcacccatcctggagggagcccatgtaaatttgggcctggcttgttgattctgaatcaccaaataggcatttgcgcagcctgcctctccaagggaacttcagggttttgctgccactctggactttgtctgaggctatctttctgcacaaactgcacaaagtggggatgaagcccacttcatgggcacaggcccttcccaggacactgcagcctctccatacccctcccccctactcaggaggcctctgtgctgctgaggccaaagatttgctttgaaaggccaaatattcttcctgagccctggtcttaacccggggctgaagctttgctctcaaaggtaaaggtgaagacctccattttcctctgctctctgcaaattgcctttggctgaagcagggaacaggaaatgaatgaccaagttatgtggcctgggagagggagaagagcccagtcaacagctcaagaaatcccgccatgtctacttaaggggaagaagagagaaaggaggataaagagagattttttttccttttaatataatgcacattaaattttaggttgtttttttttttttctacatttaggtcccttatgtggcagaaaattccaaaatatattagtaaaaatgaacccaccttacatactcttggggtttcgttgaaatgttgagaagttaagaaactttgttagattattttacttaatttttaaaaaatagcctatcaaggagttttcaaaactttttaggtgtataaacaccctatttcggaaaccaccgtattttacactttcacttcccacctacaccagctcagtgacaagaaagtgtctgaaacaaggtgcaaaatcaaggttctcagaaacacgcttgggacgtcttgttccgcagcttggctgctctttccgcccggagtgtccttagcctgtgcccctttcgaactccggcactttgtctgcggagtagctccagcgcagtctcccagcgttacctggcagcctcctccttcctggagcaggagaagcggctctgtctcctgtgttccatcatcgattatggctgctctcacactgggttaggaaggtttggtcacctgagtgcctccctcctctgtgctgttggactctatggtttacatactcctagatgctattttttacatactcctaagttttcaacctgagaaatctgaaaccatcccctaaccttacctggttacctgttgaaaaatgtgttatcccagaggtagattctttgggtcctaggcatctggacttgcaagagtctcatgtcagtttcatgtgcttacaaaggtgataacagagagggacatagctgtgagtttttcccaacggccagtgagtgcttcgttccctgtatcatgttttatttatttatctatccccagggctagtgcagtttggacatagggtgctatgggttgaattacatacttgtcaaatccatatgttgaaatcttaacccctagtacctcagaatgtgacattatttggagagagggtatttatagaggtaattaggggaaaaggaggtctttagggtgggtcctaattcaatatgaccgatgtccttatatagagggaaaatctggacacagagctgtatacatccagggagaacgtcatctggagatgaaagcagagatcagagtgatgcagctccaagacatggaatgctgaagatggtgagcaacccaccagaagccaggagagaggtataaaaggtttctccctcacagcccttagaagccaccaaccctgctgatgccttgatctctgatcctcaaggatgtggagtagctgtgtgagaggctgtctgagggctcttcaaaaagttcataggaaatgcatattatgaaaaaactatgctggatttcaaattttttgcaccaaaattgatttgtactacctttttataacatgttcatgcacaatctagtttgaggcactaagaaggataatacatcagtttgaaaagagcctctatcagagcaatgtgaatttctgctaaaattgaagtaagaacaaacatcaaatttatagtgaagcttgaggggaagtatagtgaactcattgatgctttgtgaaaagcttatggagacaatacccccttcccccaaatcagcagtttacaaatagataacttcttttaagaagggagaagttgaggctgggcacagtggctaatgcctgtaatcccaacactttgggagcctggggcaggtgaatcacttgaggtcgggaattcaagaccagcctggttaacatgtgaaaccccatctctactaaaaatacaaaaaaaaaaaaaaaatagccaggtgtggtgacaggcacctgtaatcccagctactcgggaggctgaggcaggagaatcacttgaacccaggaggcagaggttgcagtgagccgagatcatgccactgcactgcagcctgggtgacagagcaagactctgtctcaaaaaaaaaaaaaaaaagggagaagttgatgttgaagatgaagcctgtggtggcagaccattcatgtcaatttgcaaggaaaaaattaaccatgccctaattgaaaagacctgatgattaacagacatttcagttggttcagtttatgcaattctgactgaaaaattaaagttaagttttccactcaatgggtgtcaaaaccattgcacccagatcagctgcagacaagaacagatctttcaatgaaaattaaacaagtaggatgaagatcctgaaggatttcttcaaataattgtaataggagacgaaacatagctttaccagtacaatcctgaagacaaagcacaatcaaagcaatggataccaagaggtggacattttccagtcaaagcagaagcagaccagtcaggagcacaggtcacagcaagagttttttgggatactccaggcattttgctgttgactgtctgtagagccaaagaatgataacatctgtttattatgagagtgttttgagaaagttagccaaagctttagcagaaaaatgccactgaagaattcagcagagagtccttctccaccctgacaatgcttctgctcattcctctcattaagtaagggcaattttgtgaatttcaatagaaaatcattgggtatccaacttgcagttctgattttgcttcttctgacttctttttgtttcctaattaaaacaaaataattaaaaggcatccattttcttcagttaataatgtaaaaagactgtattgatatggttaaattctcaggaccctcaatattttaagaatggactaaatgggtggtatcatcacttacaaaattgttttgaacttgatggagcttatattgagtaatacagtttataaagttgatatttttcatttttatcttttgattccattttccatgaacttcctaaagtcctcttgtatttctaggagggtcttggattaaaaaaaacaggaggaaggaacaagtgagaaattactctcatagtttatggcgtgtcttaacatcaagttacttttaagtcttttattcttttaggaagatattttctctttcagggaaaattaagaaacatcagggcctgagttatgttggaaaatctctcccctactctgactgtctggctttattctgagctcccaagctataacagtggcacttgggtgggatgagagtggggtggggctcacatctacatggctgaagaccaaggcagaatctcacacccaagtcttgattctttgtgctgcttagctgttgttcacaccacttttcctgcttgtgtccagatctgaatgaaactgatggctgttggagaggcctttgtcatctgactctatctgttcctctgtcaagtaataccatcaatgatgctattcatagaaacatttcatgtttgagaggtgttaggagttgaattgtcttctagaagctgttgaattcctaaccctttatatctgtgaatgtgactttatttggatataggtagggtctttgcagatgatcaaattaagatgaggtcagtagggtgggccttaatccgtattactactggtcattctaaaaagggaaaatgccgatacagacagatgcattcaggagaattctgtgtgaaaatgaaggtggagatcagtgtgatgcatctccacaccaaggaacactaaaggtcaccagcaaaccaccagaagtgagatgcgaggcattgaataggttttcctcgcagcttcggaaggaaccaaccctgttggcactttgttcctggacttccagcctgcaggtggttgtgtaagcatttctgtggtcgaagccacctggtttgcagtactttgttagggcagccctagcagactaacacaagaggtcattgaaagtgtcatatccagaacagtgtgccttttgggggaggaaagtccagttggccctttcacatacacgaacatctcacatttaaagacacaattccaggctgtctgtggacactcataggtgcccgtgaaagccgcctcagccataaacttcttggagtcacattgtgaagtatttatttttaattacagattttctttgatgatcctcttctcttctctttttgtttccttggcttgtcactcattcgttgtggtaaatagactgcctgctgtttacgatgagaagtagcctgtgctttggtctggtctcctgacgcccggttgccagcagtccttgctgtctctgggttggaagccgtgatgcctgctcatgggctcgctgtctcctcaggcatgaaagtggaggcatccttctggctctattttcaacttaccttggtgaggccacaagaccctattgacacatgaaggggaagcacagagggaaagggggttttacttttcctcttcaacagggctagccctcggggactgagcagagagagttgtgaatgctgggttttgaaactggccccaaacgattgtctcctggaatcagagaaggaacaaccgactgcacctaaaagaaacagagtgtttaccagtcttgctggatggctttaaaaacgcaaatacatacgcattctcattagcccatagcactcagccatcttcacccccattagagaaagccagtctgctgcctgcccccctcaagtcactgctgaactcatagcatgtgtcgggcttctggaacctcacagatgtattgccgcagacaccctttagatgagaggtgtaggttaggggcacaggcaagggagcggtcactcctagacctgaagcatctcttccatagacgtcacagtatatatcttcccagccagctcctccccagcccttcagggaaggtgaacacaattccacactagagtggcttttaaagaaaaataacatgtatgaactcttcccagaattctatgaaatgaatgagtttgcattactttttctagcttatgacctgagtcttttattttttcagatacatttagttgtgtctttcaaaatctatttttgcagaacctaccctttgttagcattgggctggaaccccggaaggataattatgtgtgggacttggtagctgcccttaggtgtacaatcccataaaggagagatgccatatgcagaatgatgaaatgcagcatgaggctaagtgtccagcatgggttatggagggtagatgagagagaggttggtgcccagaagacagccgtcctgcctcgggcctatatgtctgcagaggcccacaggagtggggcagtcctgttcagggagggctgaggggttctccgaatcttatcaggtaggacagggagactttagaaaggattgggcattcagtttgtgggtgtgttataagcaaagtctggagcagctgtgagttggatttcactgggtttcatggagcagatgtctcttgctggggaatgatgggatgtaagactagagacagacacagtcagaggcgatgtctgccttgaggcagacaaacagatttcaacttggtcttctgggcctaggcagtgagaagcctggaaggtgtctgagcttggagatgacctcatagagccaactttttggaagattggttgggtggcagagtacactgtatgaaggcacaggagagagaaaggacaaatgcacaaaggaaggatccagaattccagggcaggctggacatgtgggcctgaaggaaggggaggggtgaagggagacctgaccatggcttctgcctgcttgaccaagcttggcatgtacattagaatatacagagtttgaggcctgaggacccttgttctttttcaataagtaatggtattttaaaaaccatctctgggttttatcatgagcagaggcgaattccatgcacagtgaggactgttttatttatttatacttgttgaatagtaaacagcattgaagaatgtttttaaagaaacccaaacttccttttccatttctcagtattaactttctttttagcaactagggacacaattgaatgctattgtcttaaacctgcctgacagagcagaggtacacgctggggggcgtgggaacctctatttggcaaagggaacttctcctgttattcccatatggaaagagacataaatttggggagagcttgctccttccctacatttctgtgatccatggttaacagtctcctcaagtgaatttcaaattctctttccaataagctgcaaaagtacttaaatcatttatttgttctgctcctgaaatgagagttactcactaaagtcccaaagtgtcccgaaccatgaggtgtccacagtgaaatgacatgtttaaaagttgccataaatgctggtaactggacatgataataaatctgagtcatttcacatggccagttgggtcggtaataacaagacatgcacttaaaatatatatctttttgcctttcgggctataaagattaataaattgtgtaaatttccaagataaagtgtgagacattctgaattttatgtgaatgacttgcatggtgacagtaaccatgttctggcccttggaacaggaggtaatttactgttgatggtttcttggcataatatatatacgtatttggggggtaataatttaaaatcatccagcacatggtctctgataaggtgcataactcaggtactcagagttgttttataggaaaagagatacaggcacaccgtgcgactgcaatcccggcacgttctccttcctcaggaatgacaagggatggaaacctggctccccacggggaataataaagcatgcctgtgaaaaatgaatcctggacctgagctcagggccagagtgctccaaaatttggggctttcccaggacttagtccagatttgcttctgtccaggccagtgaccgcttgaagctgtagagggcaggggagggagggtccccttcctgaaagggaagtgctgtgagacgtggctgtcactgataccagtggggacctctctgcccccagcctctaatcatgcttgaaggtttactctctgagcatggcttgagaagacaagggaaagcaatggagattggccatcacagccaaattctgcctgatatggaggcctgagtccttttgtgcaggtggtgactcactgccctgttgaatgggaggaaggaacagtgatcagacccaaacactctggttttcttcccacctgtttctcagaagtaataagtgcagggctcatgctctgcctgtgtgtgtgtgtgtgtgtgtgtgtgtgtgtctctgtgtgtcctgtgtgtgtgtctctgtgtgtgtgtgtgcctgtgcgtgtatgtctctttgtgtgtctatgtgtgtgcgtgtgtgcctctgtgtgtctctgtgtgtgtctctctgtgtctctttctctgtgtgtgttgtctctgtgtgcacgtgcatacatgtatgtccctctgtgtgcctatgtgtgtgcatgtgtgcctctgtgtgtttctgtatgtgtgtgttgcagaggagctgctaatgtgttctcatgctggttgtactgccccgccttggaacaactttatccttgggtgcaggggctgggtgagcctggaagctgccagatgcagcacatgatggaggagaagggcctggaaacttttgcagttgtcactcaacaaacactcatgcagctcctcctgtgtgccaggccaggtgccaggagctggagggaatacagagagtgagcctgccgctttgggatctcatctcctggaggaggaataagttatctacttaggtattcaattttaactggtatttaattacagccatacaagtggttccattattagtcaagctgaactaagttttgctgcaataacaaattttcccagaatctcagtagcttaacggagcaaaggttggttgcttgtgaatgctgtctgtcctacaaggtggtgctctgctctgtacagtcactcaggattcaaggctgacaggctaccttcttctttaggctgtgcattctggaacatggggtttctttagcctctgtagtggggaagagagacaagagactcactcacaagcttctctatcatactaccttatgatggaggtggtgttattagcctttttacatctgaggaaactgaggcacagaggagttaagtaacatgtccaaagtttcacagcaagtgagtagcagaaccaggattgtgagctccagccatctggctccagaatccctgttcttgtcatgctctgccatctaattaaacagtttcttgggaagggaatgaagagatgtcagacaggccaggagctcaggggactagaaaaagaatttatcagaagaaggaaagtatgtcggggaatgacagggaaggataaatgagcaaggctagaatcccagaaaaatagagagacttcatcttggctggcagaatagcttttgcaaattcgggattagaagcctggtttcatgagtttgggacgaaagctacagaaaatgcagacacagggtggatcttacggattgtgaagtcagggaggtctgaaatgaaatagaaatggcccaaggaaacctttcatattcctttttgtttccacatacatctggccacaaaagctctttggtggtttatcccatctcactgcttccttagggctctttcaaactccttgcatctatgtaagcatggataaggagcacagcagacatgggacacacctgtgttgctttctgggcatgctgtaggatgccactttttggctgtgcacctggagcaagaggcagcagggcagcagcacccagccccctgcagttgaagctaaagactgcagctgcagcgcaggaattccccagtaggacaggaaagcaaacacaggcaagataaggtcagagacagccaactgtttacagcgtccaagctcttcctgggtttggtccaccctattaaaagataataacctcttaaaacatttcaaaggatgtgttggcagtgtttaagaggaaacataattgtcaccacagcctgggtagtgtgcaattgagtaggagaccatcttcaggataggatgggtgatgggcaagattgtgctgggagaggagttcgtttgaactgcagactccagaagctacagtggctgcccaacccatgaaaacacccacagatgctgtaactgctgggtatctgtcatctttggaataaaccactcatgctggggtctcactttctaagccattaccagctgcaagggttggctttgtgaaggcaaagggaagtttactttataacgatgtaggctatgtggagatatagaattataggagcacaaagtgcattactgactcactgttctgctgcccatagagcagctcatcctgctttgtgaggcattgctgtgagttgccttcaggcaacttgggaggaagagctgcctgaaaccctttcttgaatcttctttaaggttgctgatcaggacccatctaccatgggaggactgtggggattcctccatgacctcagtgctgagctgatctggctcattaagagatggttcttacgaccgggttcggtggctcacgcctgtaatcccagcactttgggaggctgaggtgggcagatcacctaaggctgggagtttgagaccagcctgaccaacatggagaaaccctgtctctaccaaaaaaatacaaaattagctgggcgtggtggcacatgcctgtaatcccagctactcgggaggctgaggcaggagaatcacttgaacctgggaagtggaggctgtggtgagccgagattgcgccattgcactccagcctgggcaacaagagcgaaactccatctcaaaaaaaaaaaaaaaaagaaaaaaaaaaaaagaaaaaaaaaagaaagaaagatgcttcttacaaagaactctttctttgcatctcatggataatctgaattgtacatctcactgaactaccttctttgccatggctgctggggtgcccagagcaagtgaccatggcatgcatgctgtcacctaagtggctttctcttatttttcttttccttctctgttatttattctgttgtattgtttatattttgataaactcacttaaattcattttgggacaagatgggatctaaaccaagaagtagataaatatgtgtgctttagagggtagttattgcagagtctatcctgggaagagtggctcctttgttcaggatgcctttctgggtatgaggggtgggttcaattccttccatccctttctagaagtatgtagtctttgatggattcattgagtcactgatttgttctgtggacacttattatgtgccaggccctgtgctaggcctgaggaaagtgacgatgacctcagagttatgttccagtggtgggagataggcaaagactatgtaagtgggcagagacactaattacatgtaagaaccactgccttgaagggagaatgaggatgagggtgtgtcttaggtgggctgccatagcaaaataccatctactgggaggctaaaacaacagacactgatttcacatgctcttggtggctggaggtcagagatcaaggtgtcagcaagttttattctgaagcctcttcttttagcttgtaggcagccacatctcactgtatgctcacatgacctcttctcagtgtttgagcagatagagagagagagagtgctttgatatctcttcttacaaggatgttaatcttattggaccccatccttatgacctcatttgaccttaattatctccacgaaggcttcatctccaaatcacatcacactgaggcttggggcttcaacatatgcattttggggtgggcacagacattcagtcatgacagagagggagaagatctacttcctatggggtgacgcaggaagcccactctgcagagggcaacatgcatgctggaatggaaaggataagaatgaggtggctgtgggagaggagggtggggaggcatgtgagggcgcgaggtggagagaacagccagggcagaggccctgaggctccctgagcagctggtgtggtcgcagcttactcaggagtggagagtagcacaggggaggatgtgagatgagtggggcacgagtgtgcagagccttgtaaaccagctatggtgagggttttgggtttcctactacatccagtgcaacgttactgaaagattgtaagcagagggatgtcatgatctggcttaggcttaaggagctgtgtggacagtgggctggagggattgggaatggaggcaggagactgcttgtcagttttggtaagaggctgggaccatggtgatggccacgttctagaagagagagtggaatctgttgatggaggaaatgtgagagacagggagagggagcacttaagggcaactcctaggctctaggcagaacatttaggtgcatggcgatgctgtttactgagctgaggggatgcggaagggagcagaggcaacgtgtatgtaatgggtaattgcatgtgtcaatttgactgggctaagggatgcccagatagctggtaaacattgctttggggtgtgtctgtgaaggcatttccagaagagactagcatgtgaatcagtagactgagtaaagaagattaccctcaccagtgtgggtgggcattatccaactgagggcctgaatagaacaaaacggcagagacagggcaaattcactctccctgcttgattgcacatcttctcctgccctcggacattggtgctcctggttctctggcctttgggctcagacaaggtgatatggtttggctgtgtccccacccaaatctcatcttgaattatggctcccaagatccccatgtgtcatgggagggacacagtggcaggtaattaaatcatgggggctggttttcccatgctgttctagtgatagtgagtaagtcccacgagatttgatagttttataaaaggcagttccgctgcacatgctctcttgcccgccactgtgtaagacatgcctttcctcctcctttgccttcctccatgactgtgaggcctcctcagccatgtggagctgtgagtccattaaacctctttttctttataagttacccagtctcaggtatttcttcatagcagtatgaaaatggactaacacaacagggcttatacatcacctcccctttagacttgaactgagttacatcagttcactgtctgcaagctggaggttttcctgggcctccagcttgcagacagaagattatggaacttctcagcctgggtaattgggtgaatgaagtcccataataaatctcttatatttctctacatgtcctgttgtttctgtttctctggagaaccctgactaatgtagtatgtaaggcacccagtcataagggcaggctatccttccattaatgacctcattccgggtgtatctgtagcctagaccactcttctaggaaaatcctattcccttcttgtctcttccatgtggaaatctcacagacattgcaacccaacccatccaaatcagatgggaaccaggggtttaatgttaacaggtgatatctgctgctgccggtctgccattgtcctaaagcattttatacacattttcttatcttagaaagtccctgtaagataggtgtgctaacaagaatcattttgcagctgaagaaatggaggtgctactggctcaaggaacctggattcatttagagagtgtgcccaggatgagacgtgtggagagcctggcctgaaccaacactaacagtctcctggacaggaggtgagtaaggaagaagcggcagggaaggagggacaccgggtgaaaggaggtgggtgtaggaggaaggagatcacaactgtgttgaaagtcctagcagcctgagaaagacgggggaagaaggccctgcaatgaaccctgtgaccttgggaaggacaagtcctcttgcccctggggcccactgtctgagtccctaggaagtatatatacaaagggtttcggaatgcagagtttgcagatgtgggctgcagctgcaccctgtgtgtgactggatggaattcacagctagaagtggttttgtccctggctgctgaatgtatcagctgttggtgccgctttagttttattgagtgggaaggatgtagaccctgagtctggagaatgggactgggctggccatggagcctggagaagagaatgagaccatgcaaaacctttattccttgttcttggtttcttgttaaacaggcccagtgccaccagattaaggaggtgagggggcggttgtaagaaagtaagagatcagtctgaagattataaatatgggccagtgcaacaaagggaaattcttgtgtcaatatttttctgagccagcacttgggagatcctgatttccttaacaaaatgataacaaacattttttcatgttaataatgtaagatgaacatttccttcatgtttaagccactgaatgtgcagtgaacaaaagacatttacatacaggcatatttgaggatatggaaggttcaattccacaccactgcaataaagcaaatatcaccatagagcaatttatacaatttctttggttttccagtgcatgtaaaagttatgtacattatactgtagtctattaagtgtgcaataaccactccttatctgtctaagaaacatacataccttaattaaaagataccttattgctaaaagatgctaaaggtcatctgagcctttagtgagtaataatctttttgcttgaaggagagtcctgcctccgtgttaatggctgctgactgaccacggtggcggttactgaagcttggggtggctgtggcaatttcttaaaatgagacaacaatgaagtttgacacatcagttgacttttactgtcaggaaagatttatttgtagcatgcaatgctgtttgggatagcattttacctacagtagaacttctctcaaaaaaatggaatcaagcctctcaaaccctgctgctgctttatcaactaaatttatggaatattctaaatccttttttgtcatttcaacgatgttcacagcatcttcaccaggaggaaattccatcttaagaaaccactttctttgctcactcataagaggctactcctcgtctgttcaagttttaatatgagattgcagcaattcagtcacatcttcaggctccacttctcattctagttctcttgctatttccaacacatctgcagttactacctccaccaaagtcacaaaccccgcaaagccacctatgaaggttggaatcgatttcttccaatcttatgttaatgttgatactttgacctcctcccatgaatcaatgtttttaatgacatatagcatggtgaatcctttccagaaggttttcaattgactttgcccacatccattagaggaatcactatttttggcgctataaccttacaaaatgtattttttaaataataaaactgggaagtcaaaattatgccttgattcatgggctgcagaatggatgttttattagcaggcataaaaacaacattcatctccttgtacatctccctcagagctgatgggtgaccaggcatattatcagtgatgagtgctattttgaaaggaatcttttcttctgagcaacaggtctcaacagtgggcttaaaatattccacaaaccatgctgtaaatagatgctatcatccaggctttgttattccatttttagaacacagccagagtatgtaactcatttatttatttatttaatttatttattttattatactttaagttttagggtacatgtgcacaatgtgcaggttagttacatatgtatacatgtgccatgttggtgtgctgcacccattaactgatcatttaacattaggtatatctcctaatgctatccctcccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatcccgtctattattgttggacatttgggttggttccaagtctttgctattgtgaacagtgccacaataaacatacgtgtgcatgtatctttatagcagcatgatttataatcctttgggtatatacccagtaatgggatggctgggtcaaatggtatttctagttctagttccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcgtgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctttcccatgcctatgccctgaatggtattgcctaggttttcttctagggtttttatggtttcaggtctaacatttaagtctttaatccatcttgaattgatttttgtataaggtgtaaggaagggatccagtttcagctttctacatatggctagccagttttcccagcaccatttattaaatagggaatcgtttccccatttcttgttttgtcaggtttgtcaaagatcagatggttgtagatatgcagcattatttctgagggctctgttctgttccattggtctatatctctgttttggtaccagtaccatgctgttttggttactgtagccttgtagtataatgtgaagtcaggtagcgtgatgcctccggctttgttcttttggcttaggattgacttggcaatgtgggctcttttttggttccatatgaactttaaagtagttttttccaattctgtgaagaaagtcattggcagcttgatggggatggcattgaatctataaattaccttgggcagtatggccattttcatgatattgattcttcctacccatgagcatggagtgttcttccatttgtttgtatcctcttttatttcactgagcagtggtttgtagttctccttgaagaggtccttcatatcccttgtaagttggattcctaggtattttattctctttgaagcaattgtgaatgggagttcactcatgatttggctctctgtttgtataagaatgcttgtgatttttgcacattgattttgtatcctgagactttgctgaagttgcctatcagcttaaggagattttgggctgagacgatggggttttctagatatacaatcatgtcatctgcacacagggacaatttgacttccacttttcctaattgaataccctttatttccttgtcctgcctgatttccctggccagaacttccaacactatgttgaataggagtggtgagagagggcatccctgtcttgtgccagttttcaaaggaaatgcttccagtttttgcccattcagtacgatattggctgtgggtttgccatagatagctgttattattttgagatacgtcccatcaatacctaatttactgagagtttttagcatgaagggttgttgaattttgtcaaaggccttttctgcatctattgagataatcatgtggtttttgtcgttggttctgtttatatgctggattacatttattgatttgtgtatgttgaaccagccttgcatcccagggatgaagcccacttgatcatggtggataagctttttgatgtgccgctggatttagtttgtcagtattttattgaggaattttgcatcgatgttcatcagggatattggtctaaaattctctttttgttgtgtctctgccaggctttggtatgctggcctcatagaatgagttagggaggattccctctttttctgttgattggaatagtttcagaaggaatggtaccagctcctccttgtacctctggtagaattcggctgtgaatccatctggtcctggactttttttggttggtaagctattattgcctcaatttcagagcctgttattggtctattcagagattcaacttcttcctggtttagtcttgggagggtgtatgtgttgaggaatttatccatttcttccagattttctagtttatttgcatagaggtgtacagtgcaatcaaactagacctcaggattaagaaactcactcaaaaccgctcaactacacggaaacggaacaacctgctcctgaatgactactgggtacataacgaaatgaaggcagaagaaataaagatgttctttgaaaccaatgagaccaaagacacaacataccagaatctctgggacacattcaaagcagtgtgtagagggaaatttatagcactaaatgcccacaagagaaagcaggaaagatctaaaattgacaccctaacttcacaattaaaagaactagagaagcaagagcaaacacattcaaaagctagcagaaagcaagaaataactaagatcagagcagaactgaagtaaatagagacacaaaaatcccttcaaaaaatcaatgaatccaggagctggttttttgaaaagatcaacaaaattgatagactgctagcaaggctaataaagaagaacagagagaagaatcaaatagacacaataaaaaatgataaaggggatatcaccaccgatcccacagaaatacaaactaccatcagagaatacaataaacagagtatgtaattcttaaaagccctaggagttttggaatgagcgttggcttcaatttaaagtcaccaggtgcattcgccctaataaaagagtcagcttgtcctttggaaacaggcattgacttctcctctccagctatgaaagtcctagatggcatcttcttccaatagaaggctgttttgcttgcattgaaaatctgttgtttagtgtggtcaccttcatcaatgatcttagcaagatcttctggataacttgctgcagcttctatgtcatcacttgctgcttcaccttttttttaattttttttttgacgtttcactcttgttgcctaggctggagtgcaatgctgtgatctcagctcactgcaacctctgcctcccaggttcaagcaattctcctgtctcagccttctaagtagctgggatcataggcgtccaccactacttctggctaatttttggtattttcagtagagacggggtttcaccatgcctggtggccaggctggtttcaaactcctgacctcaggtgatctgcccgcctcggcctcccaaagcgctggaattacaggcatgagccaccacaccaggcccaccttgcatttttatgtgatggggacagctttttttccataagcctcatgaaccatcctctgctagcttcaaccttttcttctgcagcttcttcacctctttcagccttcattgtattgaagagagttagtgtcttgctctggattaggatttggcttaaggcagcatggctggtttgatcttctatccagaccacttacgctttctccatatcagcgataagcctatttcactttcctgttcatgtgttcactggaggagcacttttaactactttcaagaacttttcctttgcattcacaagttggctgtttggtgcaataggcctagctttcagcctgtcttggcttttgacatgccttctactaagcttgatcattttcagcttttgatttaaagtgacagatgtgtgactcctttcacttgaacacttagaggccattgtagggttattatggacctaattttaatattgttgtgtctcaaagaacagtgaggcttgagaagagggagagagatgggagaacagctggtcagtggagcagtcagaacatacgaaacctttatcaattaaatttgccatcttatatgggcatggtaccccaaacagttataatagtaacatcaaagatcaccgatcatatgtcatatgtcaccatacagacataacgatgaaaaagttgaaaatattgtgagaattaccaaaatttaacagagacaggaagcgagcacatgctcttgatacaattgcttgacacagggttatcacaaactttcaatttgtaaaaaatgcaatgtctgggaagtgcgataaaatgaggtatgcctttactgactttaattttagtaaatgacttcataaggaaaaggaaaaaatgtcattgtgagggcactgtgtttgttatagactagctaggtcatcaactgggtggttttgatactagcagagtcctccatgtgctaggacactgtttgaaattcttgttatagctttaaaagtcatggttttatcaactaactccctattagttactgtaattgaatttttatgttagcttccactagtagcaagtttttgagtcaagatggcccttgggttttattgccaaccctgacagcagaatcctagacagggtcgctttgctcttaaagcctctgatgtccagttgcaaagtgagtataattgcttctctctcagatctgtgttgaggagctcaagaaataacgaatgtggaagcactcagatcaattactttttttgtttgtttctaccttatctagtttcctaggtcaaaagtttgcttggctaatggaagaaaggagtcccaacctttccaagtgggacagattccctagctgtgctctgtatattgaatctgcttcttatcatttggctgtggtctgtgtgagtgctgaaaaggaggagataatttcacgcactagggaaatggaaaagactcctgcttggcaggcaccagggtggcaagagaatccaggatgtggccacgcacagcttaaagactacatttcccagctgcctttgcaggtgaatgccatcagtgagacctaattgagagtatagtctggggagtctgggaatgttgcctaagaaaggctgatttagttggtggtgcaactccctttttacctcccctctttctctctttctggaatgtggatatgatggcagaaccacagatgatcttgaatgaggaggtcacttgctgaggatggtgcaacagaaagatggaaggagctcaatccctgatgagcttgtggacctactgtatcagtcctggattactcactttctgtcttttatggagagaataaaccatcctctttttaagttgctcttccccctttgtttgtgatccctcttaccatagaccaaacttaattcctaatgaatagatctgccaaattgtttatatcagagatgacaacaggaacacatctgtttacattttcctttctcctgaagccccacctagtcccagagggtggtgtgtttcttcactgctattttgggcagaagctacccggctgtggtggttaaagtcagcactgctgttagcccttgtggggcctttgtgcaaattgaaaaaaggcattcatatcctaagacaccttcctgttctttgccagaaaaatgtctcaatgcaaattgacaatgtgtggacaggaatggaacatgcccttgagaagcagcccctgcacaggatgccactgctcagctttgggtcaatgtccaggccagtatctgacctcgaacttctctctaggtcttccacctttacttagcacaggcctcagaacagtccagccaggggtctaggagagaaagtggctgagactgtgtgagatggggatggggcagaggacggatagggtagagggtggattacagtgagtttctggctattgactgctttcacatgagcagctcatttctgtgccaaccatttgactagtaagttggcagaagccctgcctgttggtcacattctggcccatgctacaaggccacctggcaggctcaggctgcagcacggcaggctgtgtgcacacggctatctcccctagtctgtccccagagctgtctgtgcagtcctgagctcccatgtaagccaatgctacttttgtgtgaagaaggtggacgaaatcatcagcaactcttgcttatatagaatgtgacccaagcaatggaaagagaaaatccaggtcttggttttgtactggcttgcgagaagtccttcttttcctctctagcaatttccctacatccatccctgcctacccacattggattaaagggaagagagaaaaatgccctaagccccagagagaaaggtggcagaaccatgatattgctgctcttgactttgtaagatggccaacatcagcccagagaaatctgatctgaaatagaatgagctcacctgacttcgaaatttaccacatttgtcatgaggcagtcacttaacctaaaaagtaaacaggctcttactctgtcatagtttacatttgtgtgtgtgtgtccttttctgttttctttctttctttctctttctttctttcttttctttctttcttctttctttctttttagtagctttaacttgttctgcaaacaaagaatatgacagaacaatgtacgttcctttgaaatggcaccattaatcttgatagcaagtttctaattatgaaggatagagagctttggctgcttcatggaactgtgtcctggtgacttttttcagtccctttttcttgctttccctgtctccggtagcttccttgagagctgtggtttctcagtgttagatattcaaaagcacagcagcctacaggccatggctaaatcttctttacaaccagatgcatatgagatcttagcaggaagtaagaaaagtaaacgcattattaataaacacacttaaatgcatacaataaaatgaatgctgtttccttcaaagtaaccctcctttgcagatatagtctaaccaagcctctattgccctgcccagcatggatctgaaactctcctccgtaaattctctagaactctaggaccgccccttctaaatgcccaaaagaatcccaactgactgagggcaaagatgcaccttatttctggctccctttcgcttcaccacttgacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagtgctttgtaaatactttgattggtagaggaaaaaggaattgcatattgaaagaactgtatttccattaaaatgcatgtgtgtaaagtaaagaagggcaggaaacattgagcccaagactttctgagtttgagtgaaccaacctgctggagtggtttctggccatcactttgtgctgccatgtctcagcctgtgctaagtccagaggatctggggttccgatatttgcaagaaaaagcaaggacaacaggtttgaagtcaagcaatgggagggtctcccagagacctggagcagggaggatgagtgccttagctgcttctgtctatccatcttccatctgtctggcaatcaggatattttctggggcccattcaatgcttctctgttggctgggggctcccatcagctgccaggggttccacctgttttcagtggtccatgtgcagtactcagagaaatgcctcctgagggaatgagtccagcgggtgagcgccttttaagaaatgcggtggctcacacctgtaatccagcactttgggaggccaaggcaggcagatcaccagaggtcaggagtttcaaaccagcctggtcaacatggtgaaaccccatctctactaaaaatacaaaaaatagctgggtgtggtggtgggcacctgtaatcccagctaatcaggaggctgaggtaggagaatcgcttgaacctgggaggcggaggctgcagtgacccaagattgtgccactgcacttcagcctgggcgacagagcgagactccatttcaaaaaacaaggagtatgaaaatgctttccagctctttgcagtagggcctgtctcatggggtgcagcctggaacttgcgcaggcccctacacagaaggacctgtgcttggcccaatgctctgctcctgctgtcttgtcatacttaatactttttttagcaagaggccctgaatgccatttgcattaggcaaattctatagctgatcctgatgaggctcttctgtatggggacctgcacaactgcaggactgcaccctatgacgcaggccctattgcaaatggctggaaagcgtttttgtatttcttaaagggtgttcactccctggattcagtcgcccccaaaataacgtcttgggtgtcttatttaggtggcacctgcttggtctgaaagagctcatgtgacttcaggaaatactgaatttgttctgagaaagcctcttgccctaaaaaaaagtgtatggggggagtgctcctagtctgtcatagttaaagttcaaaggttatttacagtgtgttgcatccactgtggtgactcctggcagatcctgaacttaagcagacgtgtgttacagatcttaatgagtgtgttgatgccgatgggagttgccctggatcacaccaagtgggtgatgggtgggtgagaggagagacattctttttgttaacccctcatttccacggtcagtctcagatggtcattacaaacctcttctaaatctggacctcaacaagcccccctcacaccagggacaaagtaagggtcatgcgatggcctctgagctgaccttcgagttcagagtggccgtgtgctggtgctgtgatcattaaactgactgctttgcaaggtcagcactcaaggctatagatttatatctctcttttattctaaaactagactatgccacaaccaggtgactgtggtgcctcactcaggtggtctgtcttctgcagttgaaggcaggtctttttcctccatccattcagattgaatccagggggtcctccctggaagacctgtgttccacagaagactcccctggagcttctcctctctgcacctcagctttcttgtgggtgcagcaggccacccaggcccagtccctgctcacgacaatgacttcagctttccagggtctttctcatgcattcccaaccattagactccccagtcctctctctattttttccccttatttagtaaatatttattgaagatccattacttgcacaaaagacagcaggccgcagggaaaggggtttatagtgggagatacgatgaaaagatgattaagattgcaagttctcaaaagtttagatgttgaagtattattttccaaagtgagttacacagggtattaatgggtaccgctcaaagaaagggttctagagtgaatatgaaacattggcttaaacaaagttaaacattttaaattactgcacagcttctcaaaagttttaatatgctaatgtgtcatctaacttcccaaaaggagaaacataatatattggacttcttaaaagtatttatgacattttttcttgcattgaactagtcccagatagaagacttagccttaaagggcaaaataaaaagatgagttctttttctttttaactgacaaataaaaattgtatacatttatggcttataatatgatgttttgcaatatgtatactttgtaggatggctaaactgagctactaacatgtgcatcacctcctatttttttgtgtggtgagaacacttaaaatctactctcagtgattctcaaaatacaatacattattaactatagtcagcatgttgtacaatagatctcttgaatttattcctcctgtctaactgaacttctgtatcctttcaccaatatctccccaaccttccccatacccctgactccagcgcctgctatcaccactctacgttctacttctgagtttgactttttataatagattccacatatgaatgagatcatgcagtatttgtcttccgtgcctggctcatttcacttagcataatgtcttcaaatgtcctcagggtctgcccctctttctgcctctgtgggggctccaagtgggaattcgtggttactgtaattggcagggggcggagatttggagctggaacctctagagtctgagctctaccatggaaaggccgtataatgctcagcaagtcatttaactctttggtgtctctgttttctcattgataaatgcaaagataatagtgcaccttcactgagcttcactgggttagccaggtaaaaagccttatggggcaatgcctggctctggcaggcttgaatgctggccgctggctctggttctcccatgtggaaacaaagcctacgtctcacacccagcagcaggagcagcggggtctcggcccagccagtgtgtcctgagtggcacagggtcagacataaccaggtccatgaacatttgtgtctttgtataaggtcagacttttattgatgcaatttcaatcataaaagccactagctgcatggagttcccaaggaggtgattttctttagtgctacctgtttacttggtagttaaagcctcaggcgcactttacaaatcagtcagtattgcaaacaagacatagtagtacacttaatcaatatacaattgctatagattaaaccttctacatcagtaaacattcataaagtaatatttaacattaagagaaagggggataggataaacgggttaatgaaccagtccaagagggtaacatgaacaaggagaatgtcctggtctgatctggatggacatcaacattttgtaagaaagagactatcgtggcagatgctgggtgctggtcatgagtaacagcaggatggggtctatgaagacggccatctggagctggtgaattcttcctctttttatagcccccgagtcctctggtgaggactgataaagtgaaccttatctgattgggtatagtcactgttgattagacaaacatctggctcctgttggcatgatgtcttttaaaaatgtaagatggagtctttttctaagatggagtcacttaggtcaaaggtcctgtgtccacaggggctgcccacatttcaccacaagttgccatgagactgcccaggaggacccgaatgcctggagtgctccagccatgctcatgccacggcttttgtccctctgcctgtctttggacacctctggtgtggagttggagatgaggaggagaggcttgcattcctatcagcagtgtggaatgagcagaggtgcgggtagactgaagctctgtgtttaacctctgtttacagaatatggacgctgagagagagtctggggtacttaaggaaaggcttgattggattgcagaaaacagtttctgaaacagactatttctgaagactcaaattttaattcttttgaatttatacagcaactcatctcacaaataattattaaatgataataacaataataatgatactcttcctcctcctattatcaccaaatagcatttactgggtgttggcaaaatgctgggcattggtcaggaatgctggacttgtatttccacttgacccttcaaaaatccttgtgatcaataaattactatgttatataattaaaatattaaaattattggaaattttatttaataatagcaataatatattagtgtaaatacttttctgaataatgaaatatacaataatatattatgcacaaacacaaatgtgttaagtaaacacatcagagcttgttgccagccatgatataatgtgtattatcatatgctataccgacatccccatttgacattggaggatatgagctctgggttgctaagtgacatttcccaggttacagctctctggaggaggcagctggactccaggaccccgtgtttcctgagacctccatagcctgcctcccgctttgctgtgctgcttctatgagaagataaagtaatttaatagcagctgtcgatatgcagggccacctctcaagtgcttgaaaatagttctcttaagcgggaaatactttttttttttcccaaaataatttattatgtttcaaaagtatttcctctaattgcagggaatccaaatcaagcgcttgcatttcttataaacaaacacctctgtatactttcccctgaccatggctgacttcaaaaccaggccggcctgcaccagagcctcagagccagagaccgccccaggcagaaccacagactatgcagggcacctctgttcacctctgcacccatctccctgaagtgccgggcttggcttcccggcaacatccttcatttcaacagctaaatacgcggtcaacaatgggttggtgaaaatgggggcgcccaggagccattccatgccttcagatggggtccgggctcactgtgcaatgcatcatttcacacaggttaaaaggaaaagcagttgccagtgcctgttgttcatttaaggagattaaaatgatagaaaaagaggattttgcatttagacagtgagcagtggaatttaaaaagcagtgccagaaatcatttagtatgtgttacattctattcttttttttttttttccagacagagtctcactctgtcatccaggctggagtgcagtggcatcatcttggctcactgcaacctctgcctccctcaagttcaagtgattctcctgcctaagcctcccgagtagctgggattacaggcacccgtcaccaagcccagctaatttttgtatttttactagagacgaggtttcgccgtttggccaggctggtcttgaactcctgacctcaggtgatccgcctgcctcggcctcccaaagtgctgggattataggcgtgagccactgtgcctggccttagtatgtgttacattaaaaaaatcactccataaagatgtacaattattatgtattaataaaaaatgaaaataaaaagaccgtgtaaactgccacgtattcccactggagagctggtgagtctctccgtggatcgtaccattaccacaagagtcctctggcccacgcacaccctgctctgcccatcagcagtgctccccctcctctccgccattggcttctcatatcctcctgggctgatgtgcccatgctgtgtactcaacactgcctctggctggtgcaagcctggaagggaggtagacggtatggatggctaagcaggcgagctgggctggctgtggcctcggctgtctatcacgctgctacccagcctcggattcaggtcgaacttgcctgcactttctgaacacctagaaagatgcagcccgggcccagacagttcacttctcactcagcaaatgggaaaaaaaaatggagaaggcgctgcgtcctttgaggctcctgccctccagccaccttatctactgtgtctctctgggctcaaatggcgctttcctccagggctctcttggcgtctcatccctctacctccacagggtgtggtaccttcctttgttcctgtggttcccactgcacagctggatctctgttctcactgcctgaaattaacattcctgttcccgtttctcttgccttcctgacttccaggaggtggtggcagttactcagctctgcttccacaccctcgccatgtcttcctcaatagactcaaccctttgtcctgctagttgctagtactcaggtcacaggcagtggaactcgtcttcggcatttagtaagagatggcctttctgactttgtgccccagccacggtgcagtcttctggatctttcccagcagcgtcgacaccgtgagtgctgcctgtgcacgcattcgttgcattcttgctccagatggcagtctgaccagcacgactcaactcccctcccctcctgtccctttctagtaaaattgcctgtatgttaccccaacctctgctgactcacaggtgactgctgtcctgatttttaaccccgcagaataattttgtctgtttttgagattcacataaatggaattgtatagtacacactatttggtgcctagtggcttgaatttagtacagtgttttagaaacacatccctgctgttttgtctgtcagtagtttatttgtttgctgggtgatgttccattgtataattatcctataatttctttattcattctcctgttgttgtgcccttgtttatttccagtttttggctactgtgggagacagcatgtgtagcagtggcgctagctaggcttggacattagtctctctccagaacttgggacaggccattaaggacaggactggtgaatgtgacccagagcttgctgaccctcagctgcctgggacagcagtggcagtctgaccctgggggagtcagaggagggccacgtggtgaccgttacaccccaggagatacggactcaatgagcaaacccctgtggacaggggtcaaggaatctccctcctaaggaaatacagggttttgtgattttctttggttcaatgtcaagagaatcaagttgtgggaaatgctggaaccctcctcaactcagtgcactgagtccctgaatgctcactaaaggagacaggaaaggtggagtgcaggcctgcacagcagctactgggctctggatcagggagggcatcgtacaatatccaaggagagagcaacggaaggaaacaccagttaattcatttaaatctcacaataacatgtcatctctatttcatagatttgaaagctgaggttcagatatgttaaataatttgtccaggggtagcagctagtgtcagagccgcttcttaataactggccacagaactagataattctccaaagataaaatgcaaactaagtgactagtagaaaacattgattatatattagttttatgccaaatgctattcttgccagggtattacagttaaaaagacagacagaaattcttgccttgatggtgccccaggatgagatgaatgatgaacaaagtgaacacatagagtattctagaaggtggtctatggagaaaaataaaacagagaagaaacaggggttgtggtttcaggggtatttgcaagagtaaatatcttgaccaggaaaagcctatgagaaagtggcatttgaggacagacttgaaagagatgagagcatgaccctggggtgggattgagcattaaaggtgaggaaatggccgtgcaaaggccctgtgacagcagtgtgccaaggctgagaaaatgcagagagggcagggtgacttaagtgactgagtgagggggagtcataggagctggcgtcagaggggggtttctggggatgagctcaggtggacctcacaggccatggtgaggaatgactctttgctgagtaaggtgggaaaccatggagggtttggaacaggggagtcacatgccctgagttgcgtttaacaggatcgctctggctgcccagttgacaacagataattgtgggacagaaacatgaagacccttaggacattattgcaataattcaagcaataattcagatggtgactttgaccagagtggctgttccacacgtggtgaaaagtggtcacaataaggttcaattgggaaagtgggacccaaagatttgctcacggataggatgagggatgtgaaagaattgattctgactccaaggatggtgacattgctattcaccgaggtggggcaggtgacaggaaagcagctttgcagggaagaacaggaactcatttttggatacttcacactgggaaatgccaaggaaagctgttagacagctggatatctgcatgtggagttgagggaggggtccagctcggaaatataagcatgggcgtcatcagcgtacagactgtatttcaaacatgagagtggatggggttatctagggagtgcctctgacattctgaggttgggctagacccaggggaggagacagtagaggggcatccagtgaggggagaggaaagcaggaaagcagcggtggactggagggggtgtctggctgtgtcacagcagctcttaggtcaggtgatctgggggcttggcaatttggagctcatttgagggagattttgcagcaaaagcctgagtgggttgggttcaagagaattggggactgtggacacagacaactgcaaagggttgggtggagaggatgtaggccaaaagaggctctgtccagcctgaccaacatggagaaaccccatctctactaaaaatacaaaattagccgggagtggatgtgcatgcatgtaatcccagctactcaggtggctgaggcaggagaatcttttgaacccgggggtgcggaggttgcagtgagccgagattgtgccattgcactccagcctgggcaacaagaacgaaactccgtctcaaaaaaaaaaaaaaaaaaaaagggaaagaaaagaggcttcttctaactctttttcatggcagatttcaaacatatacaaacacaggatgaaagaacaaaatgcttgtgtctccaccacccacttcaacaatgatcttgaccaatcctgctccatctataccattccttcccttgcaaaccccaaacatgtatattaaattaattgatattgccccacctgcaaaccccaaacatgtatattaaattaattgatattgctccacagctcactgaggccccacagctcactgagaccctgtaaaagttttttgtttttttttttttttgagttcttctcccctctatgcttcatttgggataggtgccatggggctgccttctagtttgctgatcttttcttctccagcatctaatgtaccattcatcttatccagtgaactttccatttctgatattttacttttcatttctagaatttcatttgtttggtttttgtatcttccatttctttgcttgtcatgtttatgccttcctttttggtggctcacgcctgtaatcccagcactttgggaggccgaagcgggtgaatcatctgtggtcaggagttcgagaccagcctggccaacatggtgaaaccccttttctaccaaaaatacaaaaaattagctgggcgtggtagtgcatgcctgtaatcccagctacttgggaggctgaggcaggagaatgacttgaacctggtaggcagaggttgcagtgagctgagatcgtaccattgcactctggcttggacaacaagagcaaagctccacctcaaaaaagaaaaaaaaaaaggaaaaagaaaatatttgtaagattaaaaataactgttttaagattcttatcagatagtttcatcatcattgtaatttctattgactatcttttttaaaaatccagtttatgggttatggttttcttgcttctttgtatgcctggcagttttttattagatgctctatatagcgcacttttcattgttgagggctagattttgttgcatttccataaagagtgttggattttcttttggaacacacttaagttgcttgggatcaggttgaccacttcaaagcttacttttatgttttatggcaggcccagagcagcatttagtttgggactaatttagccctactgcagcaatgtccacaactagggcatggcatggatggagtggcccatgcagagtagggaggggcaaggcacgttcaagagctgagaggccattataggaaagatcatcttgtgactattaaagtggccaaggtactaaatctgtttgtccttccttccttccttccttccttcgtccttccttctttccttccctccctccttccctccttcctttcttccctccttccctccttcctccctcccttccttccctccctccctccttccctccttccttcattccttccctcccttcctttctttcctccctccttccctccctccattcttccctccttccctccctccctccctctctccttccctccctccctcccttccttccttccttccctccttcctatctccttccctccctccttctttccttccttcctttctgaaagttgggaaaataaagaactaaattccgtgcatgatcctagattggatcctgaattgggggtgaggtcctataaaagatattattagaacaatttgatgaaatttaaatttgtacagtatattaaataataatacataaataataaatttcctgaattgggccaggtgtggtcgctcatgcctgtaatctcagcactttgggaagctgaggcaagtggatcacttgaggccaggagtttgagaccaggctggccaacatggtgaaccccatctctactaaaaatacaacaattagccaggcatggtggcgggtgcctgtaatcccagctatttgggaggctgaggcactaagaattgcttgaacccaggagacagaggttgcagtgagcagagatcatgccactgcactccagcctgaatgacagagtgagactctgtctcaaaaataaaaaaaaaaaccataaaaatgaataaattttccaaatttgatcagtgtattgtgattatataagcgaattccttgttcttaggaagtacatatgctgaagtattgagatgcaaagggtcaatttactctcaaatggttcaacgacataaagagagaaaaaagaaaaaagagaaagagcacaaatgtgataaaatgtgaacaaagaatgaatcattgttgtactataattcccgggatcccaggaatatgtactcactaggacagtcatttgtcacgttgcttaggaagcaggtttggagtcttgtgtggggaattcgtcgacaccaccagtcccgagtttatgtgcagtggaaaatggagcagtgtggtcagcagtaggagagccagcttccaccctccacctgctgttccacgtggtgggtctgcacagcctggcttgtgagcaaatccatttttccttctctttgggaccaacatgggcttagagatgacatagccttgggcatccaataaattcaaatttgagaatctcaatgattcaaaattgctgctgtcaattaatacatgatgaattcatgttgttttgaaaaaagaatgattgaggtgaccaacagaagacttcaatgtttgtccccaagtaggtaggccaccccagatttccaaccctgggtgcattgcattggcaatctaaatcccaaggactgtgaactctgtggtcattctgcagtttcctctgagagtattcatgggttggggaatctcctgctgaaaaggatattgggtaaaattgctttatgtgagcactagtaaacatttagcatatattaccaagaaaagcaacactgtaagcccaggaagcttagagcttctcaaacagaaggggatgatggagaaaaaaggtgaaaagtctggcaggcaggatgaaggtcaatcaaaaaagggcagctggccacagggaaatatcatttcacccctactagcgtgactgaaaaaaatgtatgttggtgaggatatagagacattgctgatgtcattttaaaatggcatagctactttggaaaacagtctagcaattccttgaaaagttaaatgtagagtttccatatgacccagcaattccactcctaggtatatactcaagtgaaataaaaacacatgcccccgcaaaaacaaaacttgtacacgaatgttcattgcagcatttttcatgatagcccaaagtggaaacaacccaagtgtctacaaactgatgaacgaataaataaaatgcggcatattcataccaagaactatcctttggcaagacaaagaaatgaaatactgataaatgggacaattggggtaagctttgaaaatgtgctgagtgaaaaaaagccagacacaaaaggccacatattgtatgactctgtttatctgaaacatccagaacaggcaaatctgtagagacagaaagtagattagttgtggcagggctagaaggagagggatttagggagtgatgacttatgggtgtggtgttttctttttggggtggtgaaaatgttctgaaattagatagtagtgatggttgtacaactctgtgaatatactgaaactaactgaattgtacgttctagaaggatgaattttatggcatatgcatggcacctaaaaaaaccaaaagagggcagctgtgtatcctgggtttttccttgcttcttgtatgtgtgtttctgcagtccggttgagcagctatgcctcaaccctcgggtctatcctggtcttgaatgttcctgactgttgtcttcagtcttggaaccacacagcaccacagcacagcctgcaagccttcctgggaagatttacacctctaggctgagtctctgctactgcactttctcctccctctcaaatgaaaccgcagtgcctctctgtgtgaccttctcagtcatgcaatgacttctctttcatttcctataagcctctgagctctgccttctccttgccaattccccttagctccatcttcctttggccgtccgccgttgtgtaaatctgtagggaaatgtcattcaaagacaaaacccactgcttattcttctttcttaattgctccttgggaaatgtttgcttctgtgttcttggtgaaggaaagcttaattttgtctgcttttatatcactagtcttttcagattacacattcccaatcaatcacctcttgaatcaagtaattagttttattgtatcagtctatccttcagaatttcattatgcaaatataaacatgcataaatacattcatgtttccccgccttttacacaaaaggaggcacactgttttgtgccttgctttcgtttcacttactatgtctgagaacttttcacatcattatatggagagcttcccctttctttatcagctgtgtgagagtccagtgtcaagatggactgtgtttggtttcatcagtctctgtggaaggatcctggctgacctgtgtcttttgcttttacaaaccttgctggatgatctcacaatcaccttgttgcatgcacacgtaggcagagctgtagaatagactcccagtggggcagttgctgggcaaagggtaaatctctttataattttggcacatattgccagagtgccttctacagggttctatcaactgctgggcactcctgtcagcagtaagagtggctgcttctcccagcctttccagtaaaatatgttaccaacatttgaagccaggtgcagttgctcatgcctgtaatcccagcaactttgttactaacatttgggatttccgcaatggtgtgtgctaataaatgtttaacaaccacttctccaaacaaaacgaaacaaaacaaaacccaaaaccaaaaaaacaagaagccctaattgtagtatctgctgatttccatagcataaatacttctacccaggccaattgcaagctatcaacatgatgtccctgaacacggagttgggaagagatgggccgtagcacccactgtatagtatttctaccacacagatgcaagagatgcaagtagcatggataattgtgaaatgtggtaaaataataaggaatttaagagtttttatttcctttgtatttgtatgatttatttagttataaatttatataattaaatcttagcaacaatctgcatttaacaacctactcataaaaccagctcctaaaaatctggtaattattcatggtcaactgtcaagagtcagctccagcacactactgcaatgctgccaatttgaaaggtagcgaatgccatcccaatgtagttgtcatttttattgttattgttttacttgtttaaggacgatttgcatttccttttctgtgaaatatgtttctgtccttcgcacatttatctactgagttttattctcttgttgatttctaggagatccttatacatgaagctccttctgcatatcttttgtctgtgttataaactgcagtgttttttcccggtttgttatttatcttttgtgcttgcccatggcatttttctttttttctttttctttttttgccatgaagttgttgttgttattgtttcaaaatatagttgaattatttttttcattttttctggtttttttttttttttttttgacacggagtctcattctgtcacccagactggagtgcagtggcatgctatctcggcttaccacaacctccacctcccaggttcaagcgattctcctgcctcagcctcccgagtagctgggattacaggtgtgtgccaccatgcccagcttattttttttttgttttgtatttttagtagagatgggggtttcaccatgttggccaggctggtctcgaactcctgacctcaagtgattttcctgccttgacctcccaaagtgctgggattacaggtgtgagccactgtgcccagcccattttttcttttatggcgtccaaatgttgaataactaggaacaacaggattaaatacattttttttctaatcacaatcaagtttcacatacttaagcaagtttcttatactctaagcagtctgtacaattcctgtatctccttggagttcattatattcaattttgtctttttcttttgagtcagattattatttaaaaaccctctctacttaatggtatcacaaatatgcataatatgttagagacaggcctggcacacttcagctaaaaagaagtatgcatagaggttataaaatatttatcaagataccatcactagttcagtggtggctaaccccaccacttttctgtgactagtattatttcctactggggagtttcttcacttgtgtttgacttcccatgtgggcattgtcttagtaattttgtgttgctgtaacagaatagcacagactaggtaatttataatgaatagatatttgtttgacttatggttctggaggctgggaagtccaatattgaggtactgcatcagataagggaagctctcatatggcaagaaagtttacaggggagagaaagagagggctgaccttgcttttataacaaatccactctcaaggtaaagaatccactccctcaacaatgacattaatccattcccgatggcagagccctcatgaaataataattgcttaaagatcctatttctcaacacagttgcactgggaaacaagttcccaatgcatgaactttggggaacacattcaaagcatagtaggcatgtactggcttagtcctgcattgctctctccatcagacttcaaggcccaaagctctaagaatgatgctggagtgtggtttgtgttcaagaaatattagttgagacaccacattcaaaggtatgaacccctcagatagactttcatctgcatctccaccatccctgacaatgcccattaacatttagtcagcagccacacatttccagcattacttgagaagctgtgcatgtggtctatgtggtgtagcctcagaatacggtcatgcagaaagttctaactcagtgtatctaaaagccacttgaccacttagagtgagcttttatttctagcatctcatttttggttctgactttagaaatgtgaaaaccagatctcaggtatgatatgtaatttacccaaagttacctcattgctactttggcttttagtagtgcgtctggcacatagtaagtcctcaataaaatgaagagcatttgagatgacatgattttcccatttcccagtccagggctcatgtcactgtcctattacaggtatgacccaagatggtggtggctggatagtttccttccaaggtactctttaaggggtagacatgaaaggcagtgatcactcatgccaacaccctatgcttgtaacctgatctccccctggctggtaggccttattctgtcaagatttacccttagaaaagcatatgataagtataacaactacaaaatattgagggcatattatataccagttaatgtgctatgtgtccaatcctcatccaaccctgtctggtgttaatattattactgtcattttataggggtgcagagaggttataggactagtccaagaccagacagaggcaacagtagagccaggtggaaattcaggtctgtcatggtcacaatgctctttgtccgtggggcatggagttgcccaatatattattgttttacagtctttagacacagtgtcttcgcttgacaggaggcacgttcctttatgttgtaggaaatgcactgaacctgaataactctacaggagagctctcatccccccttccaggtcgtccctgctctcagcctgcacctcccattttttgatcaagacagccttgaagttctttatgtctgtggaaggaaggagacggagcttgtttttcacttttgctgccatgattaattatttttaggaaagcattgtgtcttttgagagaggattgtaagtgctgggagaataaatggatcttagagtgagccttgtgtgctccagacttccccagcttgataaacagcttcctgaccagtggctgccagtccctggtctcactggacggacattggctgggggccaatgtctgagttgaatggcgaggactggacagtgcttcttcccagccagtgtggcaatgagcccactcttaagaaggcgccttggcttgggaaaacacattgcacattagatgttggtatccgcggcagggacctgaggctggagtcactgccaggcaccttctgggaggcctggctttccagcaaggcctgcttcacattctcaggagaaccagacccagcataggaaatgccctattgcccaagaggaaaccccatgtcgaggaactgatataattaggatactgataaaaattagaatgagaaggggagggcctaaatgaagggtcatggggtgtactttttaaaaaaaacaaacaaacaaacaaaaaaaacaaaccttcctgcccttctctgcatatgaatatactacatgcttatccaagaaaactttgaaaagtaaataaaaatttcttccaataatttcacccagaaatttaacttctactatttttaaaggagtgtcttttgtatgccaaacttctcctatttttaaataatatatcatgaaaatcattttattttgtaaattggacctcaggtgtatgaaactgggttaattgtgacctatgattcatagtgcatgtattagtccattttcatgctgctgataaagtcatacctgagactgggaagaaaaagaggtttaattggacttacagttccacatggctgggaaggcctcagaatcatggggggaggcaaaaggcacttcttacatggtggcagcaaaagaaaatgaggaaaaagcaaaagtggaagcccctgataaacccatcagatctcatgagacttattaactatcacgagaatagcatgggaaagaccggctcccatgattcaaatacctccctgctaggtccctccctcagcatgtgggaattctagaagatacaattcaagttgagatttgggtggggacacagccaaactgtatcattctgcccctggcccctcccaaatctcatgtcctcacatttcaaaatgaatcatgccttcccaacagctccccaaagtcttaactcatttcagcattaacccaaaggccacagatcaaagtctcatctgagacaaggcaagtcccttctgcctataagcctgtaaaatcaaaagcaagctagttacttcctagatacaatgggggtacaggtatctatgaaatgggagaaattggccaaaacaaaggggttacagggcccatgcaagcctgaaatccagttgggcagtcaaattctaaagctccaaaatgatcttctttgactccaggtctcacatccaggttatgctgatgcaagaggtgggttcccatggttttgggcagctccgccctgtgattttgcaaggtacagcctccctccaggctactttcacaggcttccattgagtatctgcagcttttccaggtgcatggtgccagctgtcagtggatctaccattctggggtctggaggacggtgaccctcttctcagagctccactaggcagtgctccagtaaagactctgtgtgggggatccagtcccacatttcccttctgcactgccctagcagaggttctccatgagcgccctgccactgcagcaaacttttgcctgaggatgcaggcatttccatacatcttaaagatctaggtggaggttcccaaacctcaattcttgacttctgtgcacccacaggctaaacaccacatggaaactgccaaggtttgggacttccaccctctgaagtcacagcccgagctgtatcttggcccctttcagccatggctggagtggctaggacacagtgcaccaagtccttaggctgcacacagcacagggaccctgggcccagcccaagaaaccactttttcctcctgggcctccaggcctgtgatggcaagaggggctgccatgaaggtgtctgacatggcctggagacattttccccaaggtcttggggattaacattaggcttcttgccgcttatgcaaatttctgcaggtggcttgaatttctccccagaaaatggatttttcttttctattgcacagtcaggctgcaaattttccaaacttttatgctgtgcttcgtttataaagctgaatgcctttaacagcaccaaagtcacctgctgaatgctttgctgcttaaaaatttcttctgccagataccctaaatcatctttgtcaggttcaaagttccacaaatctctaaggcggggcaaaatgccaccagtttctttgctaaaacacaacaagaatcacatttactccagttcccaaaaagttcctcatctctacctgagaccacctcagtctggaccttattgtccatatcactatcagcattttgggcaaagccattcaacaagctctaggaagttccaaactttcccacacattcctgtcttcttctgagccctccaaactattccaacctctgcctgttacccagttctaaagttgctcccacattttggggtgccttttcagcaatgccccactctactggtaccaatttactgtattagtccattttcacactgctgataaagacatacctgagactgggaagaaaaaaaggtttaattggacttacaattccacatggcttgggaggcctcagaatcaaggcaaaatgcacttcttacatggcagcggcaagagaaaatgaggaagatacaaaagcagaagctcctgagaaacctgtcagatcttgtgagacttactatcatgagaatagcatgggaaagaccagcccccatgattcaattacctccccctggggtccctcccacaacaagtgggaattctgggagagagaattcaagttgagatttgggtggggacacagccaaaccatatcagtgcactctcttcatttgaccatgcaatgcatgtttttaataataaacatctccatccaatatgaaaactcatactgtaactgtgatttataaaacctttggcccaatctttttcctacaactacacttctctttatctaccttttatttttactttttgcttacttgagcacatgctatacatgcccctttttatgcctctcaggaggtttacagtggtggaatttcatcactcagatagctttccactccacgccctttggatcccaaaatggactgcccatttatctctttctgtgtgaaggaagtcagggttaggagagtcatctgtatatgcctcctcgtttatctctgattctttagcaaaaccaccctgaaacccaggcagatgtcaagtcagcttgtccttgagggtctctgctaaaggagaggccccagtggccactgcagcctccataaatcgctgtggtcaagcatgcatcttgccatcagaccaaccaccacctgatatgtgaaattcacatttgttaattatttgctagaaatctaagaagctgttatttattgtcatgtagttgaaagcctctttccgcctcctccagaattcacttttctttctatctttcctctgatcattgtttttatcctttgactgttcttttgtagttcttttctttattcctgaatttatttaagttgcagatgaggattttggctatgtccacaccccagacttcaccaggaaggtaacttagggttccccaaaatccaaccaaactgttctcaaatgcaggaggagaactctccccttcccctctacccctgccccctcatttcttctcttacaggctttcctagctcttttccaccccatgccccttctgtctctccttccatcctggggtttgtggtagaggattacccagttgcggacgagtcacatgccttatccagtgaaaatattattgtcttatggatgccaagaacaactcctgaatgtacaaactatttttaatgctcatttgagattgatagatatcaggcaaataataaaagtttcacaagattgctacaaataaataattttgaaaacaaaaccaaccaaagcaaaaaacaaacaaacaaaaacaaccttttctgttgtgattagcatttttgctaaactcaccttgggcttttgactttccagacactctcattgcaggtgtttggagctcagttctgttcctccaggcttgtgcgctctccttgaccccaccttttgtgcgtgtgctgtccttgtctgaaaccagcctggagctccctatacagatgtgtcaaggtcaggccaggtcaaggctgagcacagagaaaggagctgctgtaggaggcccacaaggaattttgttggatctgtgagatcagtgtatgctccagcccctctgacatatccagaggagacagccttgagtttgggcccagtactgccacttattagctgtgtaaacttgaaaaagtcaattaattttgcataagtctagtgcaataagtaagagtcttcaagtcatcaccctgttgtgatggattacatgagatcaagcatgtaatgtgtcaccatgataactggcaaaaataagtgcttagtaaatgctgaccattcttcttcttaacaacatcatcatcatcatcatcatcatcatcatcatcaacaacaacaacactaggtgcaagcgccagccccggccaaggccaataggccctgtgtaggttgcgggctacctactcagtctggatgctggtttcctgttctcctgctcctgtctttgctcttgacctgttttcttcttgcctctgcaatggactctgctgctggttgtgccatctcctcaaggttggacccttggaagctgacgtatagctggtaccttccagctacctcttcaacacccctgcatagcttgaactcaggtgacctgctctgctccaggctccgagtcccccaggtgcattttcctgtccttgttcccaccatgggctcagacagtgagtgccttgaaggcaggaatagggggtcctcaacccattccctggcccctgacaagcagctggctgcaggatgtcctccactacttgttagtcaaatgcatgaaacattggatgaaggcaagaaggtgagatagccaggtgtggtggctcactcgtgtaatctcaacactttgtgaggctgaggcaggtggattgcttgagcccaggagtttgagaccagcctcggcaatgtggcaaaaccctgtctctacaaaaaaaatttaaaaattagccaggcatagtggtgtatgcctatagtcccagctacttgggaggctgaggttgggggattgcttgagcctgggaagcagaggttacggtgagctgagatctcaccactgctcttcagcctgggcgacaaaaaagagaatgtctcaataaataaataaataaataaataaattagttaattaattaataaaggagagataggaaccttctcctttgttgaatccaagtttagtaggatgttcctttcttttctctctctttctttttctctctttctctctctctctttctttcctttctttctttctttctccttccttccttccttccttccttccttccttccttccttccttccttttttctttctttcttgacaagatctcaccctatcatccaggctggagtacagtggtacaatcatagctcactgcagccttcagctcttgagcttaaactatcctcccacctcagctttccaagtacctgggactctaggagcaagtcaccatgcctggtggatgttcttttctattgaaagtctagagtaattcatggccaatacttaattttagcagctttgttccttttgaatgagccctcaagccaaaaacatatccatcttttaacagtttcatttatttcctttgaaatcacttcaactggattcaatgcaatgcatttgaacagatgtttacacagtgtgttgggcattgttatgggcacatgactgagaagagaatggtcaagtttcctgccctggacagaactaaaattttaccaggaagagagatgctgagcacctaactaataaatacacagggtaatttcatttttataagagtttccaaagcaattaccatcaccaccaaagaatcagggtagattactgggtctcgacaagtgtgtgtgtgtgtgcgcacacgtgcgtgcgcatgcatgtgtgtgtcttggggaagagataaggcctgaataaggagggacagctgtcctgtggagatctggagaagattattgtagtagaggaatggcaagttcaaaggcctggaagtggtagcagagtcattgtgtttcaggggcagaaaggaggccagcgtgcctgggtgccaagggaaggaggtgagggtgaggaggcggacaggcatctcaagtgcatggagagccacctcttcttgggtccccagtccagggcactttctttggacccaggatgtaggtactgacagctgccatgaatctcggagttgtcagcattcacagcaaagggcatttccaggctaaaatctaagtaaacaagctccagaacaaagaagacaccatgttcaaagtgtgtgaaaatggataacaaataggaaacatttaaaaacaagcactttgtggaaaaccatgtttccttgatgtgctttctgtcatggtatctgaaacactgcaaaaggacattgaagatctgggagggagagttgacaatcttcccaaataagatacagttatcttatttcaaataaaaaggaagcaaaattggcacaagtttgggtcaaatttctcctgtgccaagtctagaatcagcaggtagtgctgaaatcactgtcccacatcccagacatagtgagcattcttttaaggctccaggctcaagtgtgtgcaaacagagggaaattacacttgaaaaaaaagatcaaggaccgtgaattagatacaaccttggacaacaaaagcagcaaccatgaaaggttgtatgtacttaagaagtcaaacacttctgggaaagctgtggggaagagagttggtatatgggaaaaaagtggtaaactcaaaacgccttttgtatggagaaaggcattggccagctttaaaggcactgcagcatcagttgagcaagtgcttttaataaattactctcttttgtagctctgtactttttctgatatggataagctatctagcatccaaagcaaactcatcttaaaccaagaattcaaacaaatgataataaagatggtagaatgcctattccactccatttgaaagagatgcacaaaagaaaatggtaggtgttgcttgcaggagtgtgataatagtgttgctcttctaaactggcaactttatgagtagatcatcaaagccaaggtattttactttgtggaataagaaacgatcacaccgaaaataataaaattcagcactgcaggttttctgccctttataaatgtttttcaaagacggaaccgaaagaatagcttgagtgataacaagcttttcagaaggagctctggaaattaatatgggacaggtgatggagcaagactttcagcatgaagaagcccaggaactgggaaaacacaagtctttacttcagaatcaccccatagcctccaagtagtgtgttgcaggttgaatctagctgaaaatggcataaaacagaatattaatagctatatccacatatcactaaactaggtacattcttgatgttcctgaatataaggagattataaattaaaatgattctgaaaaactacagacattgatgcaagtttctagtttcaaccaggataatatcacatctcacctcaaacaaaaggcattttcttcagaaaggaactaaaaaaaaatggcctttattctatacttgcttatggttctggtttaaaaacaaaaacaggttccagaagactacttattcaaagaccctgccccacattcctcttgaggatcccagtgaatgtggcactgataatatgaatggtttaccttccgtgagattgcattgaggggggaaatattcttagaaataaaatttttaaaaagaaaatatgatgtaaattgaccaaggggtttaaaaaatctgtcaatctcatatcctatacctagcaaaaatatccttcagaaatgaatggaaaattaagacattctcagatagaagaaaaataagaaatttgtcaccagcattaaagaatgactaaagggatgtctctaaacagaaagtgaataataacaaagggaggctggaacttcaggaaggaaacaaaacaatgcaatggttaaaaattctcctcaagtgtttaaaaaattgtgttgaagcaaaaaaatataacatcatctggtgagatgttcagtgtctgtagtggaaatatttatttaacatatttgtattttaagggggagggtaaacagacctaaataaaagtcagatttctatacttcacttgaagaggtaaaatgctgatacagttagctatgacatattatgtatatatattgtaatatctagggaaattagtaaaaaactatatgatgaagagatatattaaaaatgtactatagatatgaatatatgtgtgggttagtatacatacatagttttccttactctgtcacctgagagaacaaagaagcaatgacaaccctctagcaattagcacaccggacacacagatcttggtttctaacaccattcaccaataaaacaaatcagggctccttggagaaatggctgattccaggccttgggggaaaaatatatgagatgaacctggagcattttgtagcaccagaatgtaaggaaatgtgtgtgtgtgtgtgtgtgtgtgtgtgtgtgtgtgtgtgaagagacacaggagccaaccaaaagagctctcaatggccaaacttggaataattggagcaagaaaataataaagtagtaatgtattatcacccaaaataaatatccatgagtccatagtgatataagtaaatacttgaataaataaatggggggaaaaaagacaactctctcttatgaagaactggaaatagttaatacagatactacaacctgaaggaggagaagtgtaagttcctggtccttaggtatgggcctacatagtgattttcttccaaagagtgtagaatagatagggggtgggggaaagtagatttacactggagacacctgccaagcactacttcagccaggtgatcatggtcaacacctgctgtgataaatcgtggtgtgagtatgtaccctggatatgatgtgatgaaaatgacacttcactgctttacccattacccttgtcgaatcatgaaaaaagcctcaggtgaatttcaataagggggtatcatagaatacattgaatataggataatacctaaccaggactcttcaaaattgtcaaggtcctaaaaatcaggaaaagtttgagaaactgtcacaaccaagaggagcctgaggagatgtgatgactaaacacagtaagtatcctggatgggaccctggaccataggaagatgttaggtaaaactaaggaaatctaaataagatatagactttggttaataataatgtatcaatattggctcattaattgaaacagtcgtgctaattaatataagatgttaataagatgggacactgagtgaggatgtatatgggaactttctgttctaccatctcattttttttaaacttataaaaaataaagtctattaaaacattatagcactttgggaggctgaggtgggtggatcatctgaggtcaagagtttgagatcagcctagccaacatggcgaaatgctgtctctactaaaaaaacaaaaattagctgggcatggtggcaagtgcctataatcacagctactcgggaggctgaggcaggagaatcacttgaatttggcgggatggaggttgcagtgaggtgagatcatgccacttcactccggcatgggggaaagagcgaaactccgttaaaaaaaaatcatgagtttaaacataaaacataaaaatatataatgtttagaaagaattcacaggagaaaatctttgggacctaaggctagacagaattcttagacatggcaccagcagcactatccataaagagagaagaaaaagtcaatatactatacttcgttgtaattaaaaacttttgtggtgtaaaagactcggtgaagaggatgaaaagacaaactgcagactgggagaaattattttcaaatccatatcttttttttgtttttttgagatggagtcttgctctgttgccaggctggagtgcattggcgcgatctcagctcactgcaacctccagctcccgggttcaagcgattctcctgccttagcctccagagtagctgggactccaggcccagctaatttttgtatttttagtagagacagggttttaccatgttggccaggatggtctcgatctcttgacctcgtgatccacctgcctcggcctcccaaagtactgggattccaggcgtaagccaccgtgcccggcctcaaatccatgtcttacaaagaccttatatctacaatacacaaaaatgtatcaaattcaacagtaaaaagacaagaagaaaaatgaagaatcccatcagaaaatgaggggaaaatatgcccatgaatttcaccaaaaagactatacagatggtaaagaagtgcaggaaaggatgttcgatatcactagcctttagggaaatgcacattaaaaccaccgtgagatattactacacacctatcagagttgctaaaattgaaaacaaattataacacaaaatgctggcaagtatgtggagaaactggatcacacctacattgctgggtagaacaaaaaatattatagtcattcagataacagtttggcagtttctttaaaaactaaatatgaaattgctgtttgacctggaaattgcattcctgtgcatttattgcggagaaatgaaaatgtatgttcacacaaaaacctgtacaagaatgtttatagcagctctattcataatagctaaaaactgaaaagatgcaagatgtcctttagtgggttaaaccatccacatcatggaatactactcagcaataaaaaggaaccaactattgatacacacaaaaccctggttaatcttgagaattacattaagtgaaaaaaagccagtcctcaaaagttacatactatgttactctatttatacaacattttaaaaaggacaaagttacaggaatgaagaacagattagtggttggtgggacagcagtgaagtggggtggttgcaaaagggccacatgagggatgcttgtggggatggaattgtttcatagcttgactttctttttgtttgtttgtttgttttttttagacggacggagtcttgctctgtcacccaggctggagtgcagtagtgcaatctcagctcactgcaacctccacctcccaggttcaagtgattctcctgccttaggcctcccgagtagctgggattacaggtgccactaccacgcctggctaatttgttgtatttttagtagagacggagttttaccatgttggccaggctggtctcaaactcctgacctccgttgatccacctgcctcagcctcccaaagtgcaaggattacaggcctgagccactgcacctggccaatagcttgtctttcaataatagtgttcttgctgtgatatcatactacagttttgtaagatattaccagtaggggaaatttggttaagagcatgtgatgtttctattatttcttacaactgcttatgaatctacagttacctcaaattaagtgtaatttaaaaaatactggaaaacaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactgttgctttgtttccttctggtttctgcatgatttccactgcgtctcttgtgttctgtttgtttgttttggagtttctcacattgagagatttttctcattgttgggtaaccatgactctatcttcctgtttaagaattaggggctgggcaccatcgctcaggcctgtaatcccagcactttgggaggctgaggcaggcagatcatctgaggtcaggagtttgcgccagcctggagggttggagaaactggctgttgcattagtccgttctcacactgctataaagaattaactgagactgggtaatttatgcagaaaagaggtttaattgactcagagttctggaggctgtacaggaagcatggctggtaggcctcaggaagcttacactcatggcagaagggcaaagggaaagcaagcacatcttcacgtggtggcaggagacagtgaaagaagaagcactacacacttttaaacaaccagatctcgtgaggactcactcactatcatgagaacagcaagggagaattctgcccccatgatccagtcacctcccaccaggtccctccctcagtgttggggattgcaattcaacatgagatttgggtggggacacacagccaaaccatagcagctgttacctcatgctcctaattttgtggaagatcagataacaacttagtttcagtttggtggaattgtagcatagataactctgttttgatttttagtctggttgttggggcgtagtgagggggcttagtgggggccctgtgtgttttatctggtgaccctccagtttctcagcgccatgcatttgcttgtcctggcctctgcagtcacctttgctggctgtggcattgtgagggtgtgaaggctgcagattcttagagggggcctattccaggctctcctgtgttcatgactgtcacatcccatcttgggcgaggccaggctagagtccacaggctccactcaggctctctttcccagaccccgacacctctgtcagcctcgttgtaggtcctcttttgattgctattgccttggacctggacagtttataaaccaagcttgccaagaggcaagagtgaagaggtctgttaaatagggaaagagcttggagtctcctgggccatgtgctcagtacacaagttcttacaggtgggtagtcctgtttgggatagttcagacacaccagagtagggagtgagggtcccatgctggccacctttcttcttcacctccctcttctcatgcctccctgccaccacccaacattttcagccttgagaaattccaagtaagccccttgctcagggctgggaatccagttggcagttcgggaggcggtggggtcagagttaccgcttctttccgggcctttccagaggttctgctgctcccccaatacgccttccattgtgctccagtgcgtccctccagcacattcccacagttagattcttctggggactgttgtaggcacatccctgaaattcccgagggatctccccctggctagtgtacttccttttctcaaggtatgtgggaacaggagctgtctgccgggattagcagcccacatgatttcccagtctcaggacctgtttcctgttgggagcccctgagctctgagacatgtggttgccaagtgcttgcagcgctgggtgtggtggagccccaggctgactctcctaggtggcagactcttgggggcgagctctccccagggcggggacaggctgggggtggcgggctcttgggggtgggcaggatctccttgggtgaggggtgtctctgggggtttggctctggggaaggggttctgaggagggggcagattctcctggggaggtgggctctgggggtggggagcaggttttcctgggtgggcctctcctgggaccaactctccctggccgcagtctctcttggccacgattctttcctccacagcaacatccatgtgcagaggtgctagagctgccagtactagcttaccagcgctggctacaagatcttcaggaactttttggcctggttgttaaccagagcaactattaaaaattatagaacctcaggtaagcaaattaaatcgcaaacaaaagtaatggatacacaaaacttatactaccttttttatgacattttaccatttcctgtgcccttgaggctctttacgttatggtacctgtgtggtggaaatactgtactgggcgacggggcagctgtgcttctctccccagttcctgcttgtgtgggagtatttcaccatggaaatcagcaaatcatgcttagttatttggacagctggttattaaacatttaccagcacacaccattacctgagttctatcagcttattaaattaaaaaataaatggagccctttaatcacattgttcttattttattttattttttattattttttagaggtaggctcttgctgtgttgccccggctggaatgcagtggtacaatcatagctcaccatagcctggaactactgggctcaagtgatcctcttgtcttagccttctaagtagaaaggaccactggtgcttgcaccatgtctgactaactttttttaaaaaatgcttttttgtagagatgggtccttgctttattgcctaggctggtcttgaactcctggcaagagatgcaagtgacccttgcgtctcagcctcccaaagtgctgggatataagcatgagtcatcgtgcctggcctaatcacattgttcaagcattgtgcaaatcaatggaagcctagctcacaacacttctggtttaaatgcaggcacacttcccctctgcctggccctgactcctgctgccctctcctactcagttctctggcagctcatccccctcacccactctactccattccctgcctgctttccagtctctcgacctggacaggttttctgtccctttccccattgtttctttgaagtatttattatgtaccttcctttatcctctcagctaaagggtttcccttttcttgccaaggtttgtgatccatctctctcttctcattctcctgattctgaatttatcataacatttcctgggcacaatttaaatatgcttatttgaccttcccaggctgtgctaacagcaccaccaccactgctgctgccgaaaagagttagtgatatttatctacacctgtacctgtgccacctgtgtcccatgccagagaccccggagcactccatgggcaggtcccatttaatgctgatacctccatgagaaatgagtgtttggttgaatttaagtactgtaagggaactttttagactgccctaggtggtatgtgaaacctgagggctttgtggttgtgccaaggggcttctgagtagagaagaagaagggataccagagaagatgagactcacccacagcccttctaaccccagacctagcagagcatttcactgtccagaaataggagttgaaactgtggccttcagagcaatgttttaacctggctttagtattcttactagctgagtgaccttgggcactctgtgcctcaatttcctcatctgaaaaatggggataatactattaccttataaggttttttgtgaggtttaaatgagttaatgcacataaagctcttcaaaaagtgttcaactaataaatattagccattgtcattactgaggctatgtgcaaaattgtacttaataaaataatgcttctggtaagaggttgaagaccacatatgtagctctatggcctttattttatagttgagaaaactgaagctcagagctaagaactggacacagccagtgagcagcagagtcaggactaaatccctttctgctctgaatttttcaacaaatggtattaatcctcttctttgacctggaaggggcatgacacctacaacatttgatacccatggcatttgacacccacaccactcaacacccttgtgcctttattttgattaaaggtgtgcctttaaagtgatgagaatagtgtccaaataaatatgacagaacccttctatccattttctctgggaagaaatgaatattaatatctctggtaagatttgaatattaaacaaagagaaagaactagcccctttagtggatatagcatgatctggggaacaaagagacagcccagatgggagcatgttattggagagggataaggagcgtgcaaggtaaggtgtcggtgaacaaaagttctctgtaaaagaattggaagggaagagactttattccactaagcagtttgcaaaatggggagatgtgacctgtggtctaaaatgaaggttccttccagggagcaaaaggaggtttcagttttgacagcaaaagttcctgtccgggttcccactcaagtccatttatgcaaatgaaggattcaaacttgcttagttctaattacttgatgaagctaagttctgattggttggttcaggtgagttctgaaagtcccaaagttgaacagaggtatgggttttctgttgacacagagtacatctgtgatgtctagtcaataaatgaccactaggctcaatgttaaatttaggcccagttagccactagggatccatcttgaaggactggctctttcggtttcatattcattcccatgaccgaggcaggacccatcctgcagcttttgcccagcgggtaggagaccaggcttgggaggccattaagtcaacttcagacactgttttactgcccagggtggaggaagatctctaaactaaatgcctacagcatccacagctgaatctggctggcatgtaaagaaccagcagtaagcgatgtgcctggtgtgctggggtacacgaacggaggcgagccgggccctgtagtgatagtcagtttcactgggactaccctactccagacaggaagtcctcattgctgacagcacttaggagcagtgcctctccaccagaagtgtattctcagcaggggtggatctgagagcagaatacctagtggagaagaggggtttccacttgtggggtagagctctttcaagcacccgggccacattcagagaagttcccctgcactgggctaaatgagtcaggtggcctcacttctctcagacacatctggcaacctgggcagcttttggggtgacactgcaggaccacaggagggactccttctctctggcattctgagaggtgaagggcttcacattccagtgatggaaatcttggcaacactagagaaaggagtgcagctcctacctaaccagtgagagaatattatacatgattttgtataatctgatttgaaacttgaaataatgcaacattttcttagttgaaaaacaacaaaaaatacataatttcaaagctgttcttgggggcgaggtgcggagcgtgaactgtctcccacttcagggggtaagcaggtagacaggaatgtcaccatccattgtctcgtgggtgtgaatcactgcttctagactcctgtgcttttgataattattgcaaagtcatttcaacttttgctgtgttatgatctttaaaacaaatagtgtattctactgcaggataggttaattgtcattaagaggtgattccagtggtattgttaaaaaaagtacacccacaatcagtaaatttagaaagaaagttaggtgagataaaatatcatgaagatttaaaaacaccaggaaataaataccagtctgctaattttatgacaagcatcccaagaaatattggagatgatgctgagaaaataaaaatagcattaaagatcctcaaacagcccctgttcctctgactttgcagcatttggaggggaaagcactcttacattatgagggcctctggagccccacctaaatccttaagtgaaaactcccagggagcatcattttctgacagttgcagctggattagcaccacgtgggccagtagcctcagagaagggagtgtgcaatatcagcttcctccagagagatgccgatgggtccattctgggcccccgtttccatacctgtagcctcttaggggacacagaatgactgggaggtgctgcctattcacctgtggaatgtgggcacttctggggtctgactttctcctatatagctctgtagcttttgaatacctataataattatgtacttgtattaatttttaaaaatctattaaaaagaaaaaaaataaaggaagaggggctgagctctgctgtggaaatcagatctatttagaaagcaagaaggtctgtggacaatccaatacaaggtggcccagcctccataccacctccagctgtccccaggctgctttgcagtaacaacctatgggcaaatggcagcgtgcgcctccgtctttctgccctatatgcctgaagtcacagcggtccttcaggagtgttatgactcattcccatggggaggtgggggcgtgctaggtgtcttagtccattgtgtttgctctcataaaataccatagactggggggctttaacaataggcatttatttcttacagttctggaggctggaagtccaagatcaaggtgcagcagatctggtgtctggtgagggctccctttctggtttgcagatggccgccttctctctgtttccacacatggtggagacagggagagctctgatcccttccttttcttataagggcactaatccatcatgagaaccccacccccatgacctcatttaaacctaatgatctccaaaggtaattacatagggggttagagcttcaacatgcaaatttggcagggacagggggtggggaacatgaacatccagtccattaccatagagatattcaaatgggggtaaatgcttctgtggaaaatccccccgtgggaggctgctctgggctgtgtgtccaccccaacttggtgctcccacgagactgtgggaaagggtggcagtcctctatccccagtatggccttcagcatgtgcagtccctggcctggctacctgcagaagcccacaggaaaggggcagccaggggttgaaggagaaaagaggagagaggggtggggatgagacactccattctgaggagaggtccccaggaagaggctacgcagattctttggaactggaattgcctgagaaggcttaggacagcgctgctcattagaccactgcctgggaaatggccatcagctgagaatgtgggaccttagtgtccctgtgtctgggggagtccaagagagagagatggatactgaagattttgcaaagtggcatggctgggtgagtgggccctccaccaggagacactgactacaggtgcttgctgggcataaccgaaggagggcccggcagaatccagaccctccccattgccgtgagaggctcagggggctagcttatgaggaagagaactaaaaactaggggacacattctgaggatacaaaatgcacaatgagccctcatttagatgaggggtagggtcttaaccaaactccagcattacaccccagcctttccttgtggttctatgttgtcatgcaccatgtgcttagctacagctctcctgggtgctgccttccagagatgggaccacctcagtgacagtgaagagattaagtgtgcaagctggggacagcgggcaagtgattaacatttcctgactctgactcgtcctttggagggtgatgctacatacagcccatcatacgcactatcatggcccaatctctctgaaagtgaaatcacttctccccactgagctgcatctggaattttagcagcttggagcaatgcaaaataatggtgcttaaactcagaccagcctcctcaattttgagctgggcaatccattacacatacattttaggcagaatgggatcctggtaaatttgctgtctgtgtatgtggcccacaaatttccattcattgaacagttgtcatttttaagagctgcagggcaaaaaggttatttgttgactttttgttttttgcaaatgatattaccttgcaaaagagcttaccctgaaactgaaaagaatgattctgtgttaccatatgcttttataggcttagctcttgtctgtgggaagtttgcaagcattccctcctctgctccccattcatttataaagaaacctcccacatggtgctattaaaataaaaacttactcatatgcttagtcaatgccgagcagaatttctttcataggttccgtatgaatgagttctgaagtaacaggtttagaaaatgaaactgctcaaaaagaatatgaaaatgacttgaaaaggtgccagaaaatactttgactgtgtgtgcatgtgtgtgcacgggggtgggggaaatatcagatcatgggaaggttccaagaccttcaggttataatggcatgtgaacaacctcaggagttggtgtgggaataaacgattcaggcttaaaatgagaaactcctgttatggacaccacgggatgttctagtcaacagatctaaacacgtggccccatgactacctgtttatgtgggtgtaatcaatgcccagctctgctattcaccagctgtgtggcctggggcaagttgctccaccaacctgatcctcagttcccttgcctgtaacatgctgataataacagcatttattccataggacataggatccccacaaccccaattccttggagctcaaaaattagatgaatcttgatccttgttcacagtactttccaccacggatccatccatgactttgtcatttatttagttatgtaactagttatttccaatattgtaatgagcacccatgaatctaccaccaaacaaaagctaagtctaggacaataacctacatcttatcagctagtccccagtatcttattaacctcttctccccacttctaaggtctacaccatcatgaatcttgtgttcctgatacccctgcttcccattttatttggttttatgcttccatatgtatttctagaaagtaggtatatttttatcttaattgttttttaactttataaaacttttagggacttacttttttccatttaatgttatattgctaagagtcattcacagtattgtgtgtcattgtaatttctttgttctgactgctgcatagtagtgtatacaaataaaccatagtgtaatcatccatactcccattgaggggtacttgggaaaggagagggtccagacttttgctagttagaacagggctgttatagtcctactggtacatgtcagcctttgtacaagtataagagtttctcttgggtatggaccttcaaggagaatcatgtcagagaacatgtgaaagttcaactttaggagacaatgccaaaacattctctaaagactctgtgctaatctacaatgccacaggcttcatcctctccagcacttaattgtgttaggctttttactttttgctaattgaatgagtataacatgttatttcattgtgattttaattttcactttttttctttaacaaatttttttatttttagtttttgtgggtacataataggtacatatatttatggggtacatgagatgttttgatataggcacacaatgcataataatcacatcatgggaaatggggtatccatcccctcaagcatttatgttttgtgttataaacaatccaattatactcttttaggtatttttaaatgtacagttaaattattttgactatagtcacccttttgtgctatcatatactaggtattcataatttttttcacttttctttttgaatcttttcataagtttattgggcatatatgtttcctcttctgtgaaatgccattggtgctttttttccccattattatactggttatttgtgctttgttaacaaaattgatttgtagcagttctacatatattcttggtactaaacctttgtggttgatattatgaatatcttgtcccagtttttactttgtctttttactttttaaaggtatctcttggtgaacaaatgttctttattttgacatagttaaatttatcattttatagtcaacaatttaagtgcttaagaaaaactttagctgcgtgtattagtccattcttgcattgctataaagaactccctgagaatgggtaatttataaagaaaagaggttaaatgactcacagttctgcaggctgtacaggaaacatggttgggaaggcctcaggaaacacaattatggtggaaggtgaaggggaagcaggaatatctgcatatggccagtaggacagagagagaaggggatggtactacacactttaaatacagaactagggggatggtgccaaaccactagaaaccacctctatgatccaagcacctcccaccaggcctcacctccaacatttggaattacaattcaaaatgagatttgggtggggacacagagccaaaccatatcactactccaaggtataaaatagttacctgtattttactataaattataaagtttcttttttgacatttaattcctgaatctatctagggttatttttcggatatagtttgagagagatattcaagttcattttttcccatatgaataactacttttttccacctccatttgtttatcagcctcctctcctcactgacctcctgtatcctctgtaataaaccaacattctttatttgcatccatctttttctgggatcttattcataccccatggtctgtttttctgtctctgcaccaaaactacagggttttaattgctccagcctcataaaagtccagacatcaataagggaaacccctgatcactaccttttcagaaacatcctatttttggtcttttatgctttcacataagtttagaatcattttttcaggttctatttttaaaaaaattattaggaatttgacaagaattgcactgaatatatagatcaaattacactattaaattatataatccatgaacacaatatctctctccaattacttagccctttttaatatctcttaaagttttacacttttccttctagaggtcttgaaaatgtgtccattgttaggtttattctaggagacttgatattttaatttttttttttttttttgaggaagggtcttattttgtcatccgggctggagtgcagtggtacgatcatagctcaccacagcttcgaactcctaggtccaagtgatcctcctacctcaccctcctgagtagctgggactataggcacatgccactgtgccccactagatacctgatgttttctgatgctgttgtaaagaatattgtcttttagcctgggcacagtggctcatgcctgtaatcccagcaccttgggaggctgaggtgggcggatcacttgagatcaggagttctagaccagcctggccaacatggtgaaaccccgtccctactaaaaaaaaaaaaaaaatacaaaaattagccatgtgtggtggtttacacctgtaatcctagctactcagggggctgaggcacgagaattgcttgaacccggaaggcagaggaggttgcagtgagctgagatagcgccactgcactccagcctgggtgacagagtgagactctatctcagaattaaaaaaaaaaaatattgtcttttaattaaactttctagctgtttgatgtatgtaaattttatatcttcactaaatttaattgttcttaatcatttgtttatggattttgggcattttctatataagcagtcataccttatgtgggtgataatggtttctttccctcataagatgattttaaaagtgaatggggttatataaacaaagcaaacaacacagtggttggcagctagtcagtgctcagtaaatgcttgtgactactgatattatcgtcattactcattaacagaagaattttagaaatttctttaacaaattccttcatgttgaagaaagaaacagaggcccagaacaagtccatgatttgcctgggatgacatgacaactcaatgccaggactgcacctggaaaacctgggtctttgggctacaaagtcaagtgccctttcttttaatccccaacaaatgcaggcttctgtctggcataaacttttgcaattgtagtgtttacatgaatggggctttctggcacatccatgaaaaaaaatctattaaatcagcagcatgaattaagctctttctgtgtgctgggcttcccacattgcacacgcttctagcagaggaagaatttacaccctgcaactcagaggggcagaaaatgataatttatttccttttaaatattctctatatggatctcatcatttcctgttgatggcagaggaaggagggagaaccttaaacttgcccattgaaagcaacttagactcttttggtctaactcactttcttttgggtaaatacacagttaaataaaaattaagatttccttctcaaaggatgtctcttcactctctatgtcccaggttggcagctggaagagggaaacaattatggattctcacagtgtggagtggtgcctctgaactcatcctgcctttgagacatagcaggtgctgattgagctgggcctggcctgatcatgtctttgagcatccaattctggggccactaggtctagctgtctctgctggtgctttgggacctccactgctcagatcttcctggccccaaagatctctaaatctcagctttgtctgtcatctgtctctaggctctgcaaaggtgacctctcagcagtctggctcgcagctacaccctctgggggcacgtagaacactgagacccctttctggccacagtgtagcagaggaagaggcaggctgtggggcacatgtgaggtattctcagatactagctcagccttaacttctctcatcttctcttctctctgcatccctccctccccaacttgcctcttggccagaagagtgtctccttcctgttgggtggggtttccctaacttgatgtcctctgtcttctctttattcaggcttatagcaagctccacagtcacactggcaaggcctagctctttgaagatgaagggaactttcagaatctagaataatgtgtgtcctctttcaacaaaacttgacattggaaacctgtttctccatggcctctaaaaatgtcagttttggcatgcaaatattttctaaatattatcccaattacccatggttatggctgcctttgggattatgatgaagactgtagttgtgtagaacatgtcatgctcctgactcccctctcgggatatggaggccactgtctttgtgagtggatggagctccttcctctgtccatctcttaactaatgaaagccaggtctgtctgttctcagcagtctttctctgcctagccactgtacaggacactgtcactaacacgtcctcaaggaatgacctctgacttctggcctgaagatctctgtggcctctattcaacctttattgagagcttattatggttacagctctgtgctcgtgagaacccagagagagcgagacagaattgtcttcaagctgctcaaagagtaaaatccatgcataaagacctggctgtatcacagctgtgcttatgatattagcaaaatccagtacaactaggaagaacatgtacagagaaggaaggaaaggcaaaactgttgggtctagttttcttggttcctacatgaaagaaggctgggcaatatttaccctcgataaagttcattatgccttgggtatagtaaaaatctgaagttttgcctctgtagaccactattctgccagggctgggtgccagagtgtattttacaatgctgacgcctgtccgagacagtgggttgtggtttctgttccactctccaatgcacttttgggaaggcaggtgactgggatggacctgctctagtcatcaaatgtggcaggcccactttccattgccaacaaaagttaagtaaattaaatagggccccaaaggagctctctaggagttggtgtatcatgaaatgtgaagtgggcttgcccctatgcaagaactaaaagaaacacaatttagttatctttggcttctgaggcatcggcagagttttctgctgccaatatgagatttcagtggagagtagggtttcccaaatcatgttgaaacgtgacattgttttccttaggcccacagggccttggcctgacactgagcatgtattcgtgtgtgcacacacgactgaccactttctgcacgcttcttacacatccgccatgtgtccgcctcagccagtggaagccctgtgccactcttgagatgcaggtggctgtttcttgctgctgtcactgttactgctgctgccgcttgcagcctaattcctcgctggtttcaaaatgtgtctcagagatttccccaaatccatttctccaaattctgagttgttcatccatggataacaacaggatggcatggatgtaggcactggtaaagaagcacagaagcatgtactgagggtgttaattctgaacatggagagactgcatgttctgaaacacatcttagcatttctgtgtccacatatgtgtattgcatttcaagcatttttattattattattattatttttgctgggtcgtgtcaatagaactgacagcatcctgtgaccatatcttcacctttagtgctttctaagtaaaactcagtgtcttaatatagccaaagggaagaaaatcctagtgagagaatgaactttttctgacattcctggttggtgaaatgcaatcctcttttcctggcatttggtgaggataattgaatttatgtctggtaactaaggggatgctcgggagcctcaggaaccatgagcaggaatgaggatggtcagaaagcacattgggttatgtggattcagtgacacaaaccccaagaaacctggtggcttttggcactgcatgtgattagagacaaatgatctattttcatcttctggaaaaatcaataaatacatatataaaagagtgccttcaagtcctttgagctattaagaatagctaacgttttgattgcttattgcatgtctattgctgttctaaaggctacatatgtattcactcatttcttcttataacgtccctgtgtggcccacggtcatgttattttcattcccattttacagataagaaaatggaggtcacgagctggagaactccttgctcaagttgcatagctaataagggacttagctgggattcctggccagcaatgtggctccaggcctggtttctaacttccccttcttggcaaccaccttcacagaggaatgcaagaggtgagtggatttgatgtgatattttatatcatgcctatttctatccactttctctggagtccactaagattaaagaaggagagaaattctctagttctacaggaagtgcgggctgtttccagtgggtccttgaagtcctttgtctgtttccagtttttccttcaggtcttttgagcccagcttccctctggccagctcaggctcagggagacgggcatacaccggtggcctgggtgacagtgtgcagctgatgagccacaggacttgggcaggccatagtgggtcaggagagactggacgcttcgtcttttatgcttctgggatttctgttgtggcttctgttttcaccgcatttcaaatcctttaagttaggtcatatggggaaaatgcttgtgcttctcatttatctccctggaggctagcctggatctctgatgaggaggagcaccaggccactccataaccaccgggctgcaggatctccagggccacccaggaagccaaaatcagaacagagctccttgctgtgggggctttgctcaccctagttctgggagccagccagctctatcttggggatataactttccagggacaagagatgcctgattttgtgcagacacctgtgtcatggagagtatttcttatgttccaagcagagaagttcaaatttaccagtcttcctgtcactccacccccaaaatctggcgaccccactcagctgtttttcagggcccaccctcatggcaccttctggggactccctctttgctactgaggttgagacctagcactaggttttgtgctagaagcgccttgggggcagaaacccccatatgccagctgcccaggtcaggactgcatgttttcctactcaccgccaccttgccttgtatagaagaggtgtggccacgtgcggaatccgcgggcacaggcagcgaggccaatgaatggtatcttgcctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtccctgtcgcttggaatccctggaagaaagcagaaccgagaagagaagcccgggtttaacgctgtggtttcttttttgcaagataaaaccatgtgatttagatatatgcaaacaaatcttgagttaaaggaaactgagtttcaaattagataattgtctctgagaaaggcattcatatatctcatatttcatttctaactttttatcatagaacatcttaaacatacaccaaaatagagaaaattataatgagctcccatctgtcacttgccttcaacaatgatcaacttatggccaattatgtttcagctacaacccaatctcgccccattctaatttttttaaagcatatcctaaacattgtatcattttatctgtaaatattttagtatatatctctaaatatatatgaactcttatttttaatagacataatcgtaatcatcatgattttaggaaatgattttaataaaaatcacacccaattcacgaagttaaaaaaccctcccaatattcacacccttctcattactcttggttttaaatgacttttcctgttgtttgaagcctgcgttgcagtctgactctgatccttccaaaaactgctcctagagaagctagaggtacactctgagattaagctacctcaacttcaagcctctggattctgggaggagttgagtccaccctctgatctagagtttccaggcatggctttgtgaatgcacctaccttcttcccagatttttgcccgtctgaccctcttacatgagaacatccccatacatggctgtggaaaatcctcaagtgcaatgaaggcaagactgaaaacagagccgctgccaaacagagcagcaagttgaagggcaagtgcctgtcaacacaatccccttgaaagactataaagagctgccaaaacatgagatgcatctgacatccagatagtattagctgactgcttcccaaatgggttagctgtctacagaaacgccctaggtagctgatatgaatcgcaaatgtgctgtgacttgattaatttgtaacagtcagaaattaggtagttcagtgctagtcatgctcaagcttagtagtagctggtttagttgttttttgttttttgtttttttctgtgggtaattggatctaggatgatagtgtaccatcccccagcagtcatagaagacatggtaaaaactagctttacacgggtcctggacttgaggtcacgggtgtggaaggtgattcactagggagttggctcttagcttagtgggtcatgtatttctgagaagcttctttcctgaggtttacagtcagtttcagaggtgaatgaactgcttcagatgatcagaaagatacactctgtcattattcccccaagaataatctttgcttctgtagttacattaaagctaaattttgctgccagagtaggagccatccattatattataatcgatgacatgaatgttttgctcaagttcagatgtctaataagagtcattttctttccgagggagtgttatcagtttcatgaatatgcgctctgtatttcattagcattcttctagcaaaacatgattctgagtcatttctgaaatatctgctctcgcctgcaacttgtttctcagtttttacaaaaattgccttttctacttactggcagaaaagtttgataccacacgagcctaaaatgggtatgctgagaaaaaacacagcacacctatggaaccgtgaccacaacagtgcatcggtctctgtcccaccgtctcattcgaggttaatccctctccacagggcggcacctcagcagggaagggcgagtctgaggactgagggtaaacagtcatgacatgggtattcactatcatggctttcttagatttttaagccagaatgaagttcagagagcttgtcagaggatgttgaatgaacagaaaaggaaatttggaacccatatgaaaagagctgctttatgaatcacagagagcttttgagttccagcttacagtaattcaaataccactcacttatattcaactgagagcagctctggcccagccttgtcccctgaccccggggacactttctctaggatgaacaagagaaggtgttctccactgtactagctgccagtgtgtttctttcaaccaaggaagtatccatgtctcttattctatgtcattattgtaagaatggtctaccttgatccttagaagccaaccaggatggagtcccattttgcagagtctgctgtgactgccagccacccctgtaccatggacttccacagcaatgatgctgtgctgcatctccatccaaagggattgcatctgttttaattgcttgactttcaaggacactcagggacaggtactcttccataattctacgtcatcccagtttcacaggggcgtgaattccccatcccctgcaaggtctactgctctccaaagtgtgtgtctttgagatggaggctcttcacagggttcaccacctctgcaagtagggctgtgacaactcagccttgtgcactgccacaaaaggcccttcaagagcttctagaaatttctggctcacagaagccactggaatactgtaaatggagttggttttggtggctctgtcctttgatgggaggctctgtctcctgaggccaagattgaaggcaggatctgaagattgtgcgcctggatcaactctaatcctttccagcccaagagagttgttcttgcttcttcttggactgttgtgagaaacttccacactgactgcttggaagtgtcacatgttggacctcttggtaccagtgtctctgacagactcataccactgggagctcagagcgagtggctgaggccagcagagctgaacacttagtgccctgtccctgcattctgtgggatcaagaatgaactggaagtaggatgccgccctagaggaggcacaggtgctacagaggcagctcagctcaggaagcggacgtgaaccccttcctaccccccattagtgctgtggccatgaggccccctcacctgagggggaacacctctgtcagcctggctatctgccaccaacaaacacttttcctgggaaggggcctggattcctccagttgagcctccttagatgcacaggttgcaccagggtggaggccacagccaaaaccaaacagtgtagcatgaacaggccaggctcccagagtgggaagggaggactggctggaggcagcaggaggctggagccacatttgcctgcaaaaagtcttttcagacgcacatctcaggccagttacgcaactggctcctggatccctctgcccaggcccagtccctcccattgcctctcagtgtaaagcagggaatgctgcaggatggagagtcctaagccttaatcgtggatcttgggattcagagtccagagaggataaagaagcaaattcacagtcaacacttcctttttttggatgtttaccatagtgaagttttgtgcaaagtgctatgcggacatgatctgacacatcatgttcccccaccctcccggcccaggatctgaaggtccagcaggagaggcaagccaatgctaaccaaggctcaatctgatacagggacacagactgctctggacttccgtatatgcctttaaaaatatatatatatctttaggctgggcgtggcggctcacgcctgtaatcccagcactctgggaagccgaggtgggtggatcacttgaagtcaggagttggagaccaacatggtgaaaccgcatttatttattttatatatatataattttattaataaataccctggaaggaccttgttcctttaacgtgctggcacctatagcagggaccaaatttgtacttttacaaactgtctgtactggtctaaggaggagcagaggcgcacatacaatagctgcttatgcagaatcactggaaaacaggtgattcctgaacgttgctagatgaatataactcagaaataacccacagcctagattagtaatctgtgaaagttggagaccaaatgaaatttgtttagcaataaaatgcttttgaagagaatttctctttctttgatgttcttgctcattactgtacactctaatggtgttgggctcagaactattgctcaatagaggtttgataaatgaatgctccagaagacacacagaggctatcagtgtggtcgttgtcaatgagtgtcccagacattaaataagagcctgcaatgcctgagagccatgcgcagagatcatgggactgacacctggggagaggttctgaagggacctaagcacacagacaggagggaggtgtcatcagcagattcatccagccccatgttttgtagatgaatagttccaagacactttttaatagttatccaatcctgtatctcctgagcatgctcagtgccatagagcctcagtttccacatttccaagcagacttttctgttctctcataagcacatttgagaaaggacttgtttccccttgctgtcataaatgcccttgctttcaagttcaagccaaaaagaagcagtgcaattgttcttcaagctgatccggtgcagaggaaccgcaaatgccagctccagctatggtttctaattgaatatgactttctttgtaaatgcctgtccttgcccccagcagcaaactgacaactaggacttgcctttgtgagctgaaatgatgtcgctgataaccaacagcttgtattaatttttcctgataatctcatagtacttttaatgagattggtggcaaacatgccattctggggcaaattaatttgtccttgcaaaacagagtgtcagcgatttttatttcctttgtctgacgtgtaaatgggttgtttccaatggcaattgatacaacctagtattttcggctgcactgaagggagaacaagattttgccaagagcaacaaaatcagcacaaccacaattaaagcagatgatcgacatttggaaaatggtctgctgatgtttcttccttcgttttccatgctgaaataggttgtgatttagacaagggccaaagagatgaacaaggcagccagcggctgctcagcctccatgtagcctggtcatggagaagcaaaatcgacatgaaatgtgaccctctctcttttatgtgctttcacatgctgtggtcaggaaccaagtactgtatttgcattcactgctcaggcactgtgcggtgacctgcttttatgccactttgcattgctgaagtgatgtgggtgaaaactggaatcctagttagaaggaaacatggcatccgactcttccattctctcatttccaatgtattgtgttgcctctctcacccgccaaagaaatgaaatgtgattttctaccagagttggaagagttttggccacaatataagtcattatggcagtttccattttctttgctatacattttgaacaaggaaccacagttcatggaattgcattgaaaattaacagcttttttttttctttttttttttttggccaagctagccagaaaggaacttgcatgagaaattcactaatgctaatgcagtttttcaagtggtaatatttctagaattttaattaggactttttttttgctttgaagggtcccatcacagaagagaaaggaatgctaatatttgtctttgatggccagcagggtcctggaggacattaacgttttgcaagctgaatgaggtcttcccactgacacgagcataaagagcaggtggatttaacagctttcattccattttctatttagtttaatcaagataccagttaagaacaaggggaggctgctcccagagcttctctgtccttttaggggttgaccctactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctcagttttatgattcctaacttagagttaaaagaagcaagccatacaggtaaatgattatcaggcagagaggcctagaatgcattacagttatgcaaaacctgggtttttcataggtgtttttaatgttggtgtgaacagtggagccaaatagcatcttgtagcccctacgtgggcacgattctttcctgggcgacaccgtctgcatgccccatggtgacattcctgtgcgcttgctacagttggctagtaatcctggctttgaagaaggttttccagtgccaatcaccatgttcaagacaatgtgtgggccagtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgcaggcagttcaaattcagcaggaaactactcaggttcctcctagccctgccccattctttataacatggaaaccctgattccccccgccgaacactttccttcaggtagcaggatttttgcttcaccgtaaacacaccaggatcacggatgatgatagcatttattgcttggaataaaaagtgatttgcggccctgtaaataggacagcaaatagttttgcttttgacctaaggctcccatgtcacttcatgatttcattcatcttcatattcaaaagaaggataaataaactgctttcctgcttagtagcttggtcatctgaaatccagtatctgacatcaattcccagtgggagaaattgtgctttgctgcgtgtgtcttaactcagtctctgatgttctggttctgactcaggatgttggtgacagctgcaccacatatgccacgtctttcatgctagactaagaccagacatcttttctggtgcgcatggagtcacactgtgacctagaagacagtgctttgaaataatgacaaagcacagaggcaaggaatgaagttgacattgcataccaacggcatcatcaaatttgtcctcaaatgtcactgtgtaatgctgagtgatttttggaatctccctagtttcccccaagcaaattacatatcttcataggcacatcgatatcaatgttttgaatgtaatatattttaatgaatatgtaaacatgtacaaataaatataatgaatataacaagtatgactgtcctatatgagacatagatattttcaataaatgtatatttattatgaatatatatttataatataaatatcaatacaatgttgttgaatgggtgaataaatcctttaaagcagcctcaatgttataagtagtcactgtgattcattcatctcatacaagcattctctttctatggatgtaattaatacttatggcaaattgacttttcttgagtctcatgaaatagaaaaattcctttctgacattttgactattctaatatggcacaatattataattttagtgcatgtaatcttttccacccagaaaattggcactttctaaattcctggtttcttatttgaaaacaaaaaagacaaaaattatgacaaatactaccaaattaatatttaaattatatttgaatggcaaattaatacttaaaattacattgctaaaaactaattccagatacggagcaaacttaaatgagaaagataaaacaatttaaattttagaagaaaatataggagggcaacttcatgattttggccaaggcaaagatttcttaattaggatgccaaaagcaccattaaaaaagtgggtaaaataaggcattgaaataatattgggggctgggcacggtggctcatgcctgtaatcccagcactttgagaggccaaggtaggtggatcacctgaagtcaagagttcgaggccagcctggccaacatggagaaaccctgtctctactaaaaatagaaaaatcagtcaggcatggtggtgcatgcctgtaatcccagctactcgggaggctaaggcaggagaatcacttgagtctgggaggcggaggttgcagtgagcagagattgtgccactgcaccccagcctgggacagagggagactctctcgaaataataataataataataatattgggtacagataataatttcctccacatgtgtgaaaaagaaggttatgagaatcagaaagcaggaatttagacaatatgtaggggcagcagatttcccttgttttgtaaaacaggcctcagagaggagtatcaacttgcaaataggtcaaaaaccctttgagggaaggaagtttctgggcagcagaagctttaccaccatccactgtcacatggatagggattgcaacatactggcccttcactaataacatctcgtcccatttggatggcaaccctgtgaagtacatatgatcatgctagggaaactgaggttgagtgaggcctggtgccatgcccgaagttgggctgctgtccagtggtaaggcacgggctagctgtgtcagccctaaagggcaccccactacatatccccaagatacaggccacggggctgcaccctcagccacggcccagcgtccccaaggctcagcatgagtttgcatctgctccttccctaggaagtcatttatttacataaatgactaatgatcctgggcaagggctcctgttgggccacatgttctgctttttaaaattcagagcctaggtcaactgtttgatagaaaaatgaaaacataatgtaaattctaaataaagctgatatgcaaagaaactgccctgttaacttaccttacttgtagatcatattttcggtggaagtctgttcagtttaaagataaacatgacatgattagaggagaaagaggatagcccctccctttaagctccaagataattcaagacatcagttaactattgagcgattagagaaggtgttttgggagctgaccttgacctagtattctcaaatctccttcccctccataaggcctggtatacttcatgttgctggcagtcaacatctgtctggcttatgaagaacgagataatcacactcattttggggcctcaggctatgagcacctgagtgtgttaatatcaattaaaaaccccagtacccatctgttgaggtcaggactattaaaagtcaggcgtggctgggcgcaatggctcatgcctgtaattccagcactttgggaggctgaggccggtggatctcttgagcttaggagttcaagatcagcctgggcaacatgatgaaaccctctctactaaaaatacaaaaaattagccaggtgtagtggtgggcacctgtagtcccagctacccaggaggctgaggtgagagaatcacccgagccccagaggatgaggttgcagtaagccatgatcgtgccactccacttcagccttggtgatgggagtgagaccttgtctcaaaaaaaaaaaaaaaagaaaaagagtcacgagtcaggagtcaggtgtaaatgcctgtatatcagactgtattttagaaatttgcttttaaaagttacccttgtgactgagactcaaaaagaaacttccaggatgaatgttcaagctttttttttacttaataaaaatacagctttaaggctgggcatggtggcccatgcctataatcccagcactttgggaggccaaggtgggaggatcatttgaggtcaggagttcaagaccagcctggcaaacgtagtaaaacctcgtctctactaaaaatacaaaaattagccaggcacagtggcatgtacctgtaaccctagcgactcaggaggctgaggcaggagaatggctgaaacccgggaggtggaggttgcagtgagccaagatcacgctattgcactccagcctgggtgacaaagccagactctatctaaaaaaaaaaaaaacaaaaaaaaacaagtaaaacaaaaaattttgcctgtgatacgataatgagtttcttttaaaacttctgagattagtgtcttagagatttaactgttgtgttttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaagaaaaaacaacaacaacaacaacaacaacaacaaaatgatcccccaagaatcaataataaccagaataaggagccattatcagatattctttattactcttaattactgttaggcttcaggaagccactagttgggtacagctgcccaggactaaacctgtttcttacaaggtcctacagccacaaaaggtggacaccacaacctccatttataaaacagaaaacttaaggctgttgttttgcaaacacatagattaataacatggttctgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatcgaatctctgagggagcaatgagataggaggtaggtgggactcaacccaggaccagattgaagactggctgacacaaggaagagacactggaagcacctgtccataacacatgcccaccagtgccatatcagtttaccattgccatggcaacacctgaaagttattgcccattttctagctatttctgaataacccactcctttattagcatgtcattaaaactggggataaatatgagtgcaaaactgcccctacgctactgctcttggcacaatgcctatgtggtagctctgtttcacaagaacagtcacaaagctgtaacactgccacctcagtaaagctgttttcttctaccaccagcttacgctgcattccttcctgagtgaagccaagaacctgccctgcaccacttttgtcaagtcagttgacataaaattactcataatatcctctctttattttttgactcctgtaggctgtgtaatgacttcttcctttccatttatgatattgtgttttgtgtcatttttctttccctcttctttttttttgagacagattcttgttctgtcacccaggctggagtgcagtggtgcaatgttggctcactgcaacctccgactccccagttcatgccattctcctgcctcagcctcccgagtagctgggactccaccacgcccagctaacttttttgtatttttaatggaaatggggtttcaccatgttagccaggatggttttgatctcctgacctcgtggtccgcccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaatagataatttttttgttcctcaccagtataattcacataggagtagaaatctcaagtttaaagtgtggatttgcactttaccacttggtgtattcaagaagatgaataatattaatacatcagtagggccaggcgcagtggctcaatcctacaattccagcactttgggaggccgaggcaggcagatcacctgaggtcaggagtttgagaccagccgggccaacatggcaaaaccccgtctctactaaaaatatgaaaattagctgggtatgttggcacacacctgtaatcccagctacttgggaggctgaggcaggagaattgctttaaattgagagatggaggttgcagtgagccaagattgtgccactgcactccagcctgggtgacagagtgagattctatctccaaaaaaaaaaaaaaaaaaatcagtagctttgaattttaaacatctatttgacaagaaattcacagttctttctctcttaaataacgtaataattctttcagtaatgagcctggtttgatgcctctctccccaacatgataaaagtatcacataaatctatgaaaaattcaatttccctgttcctacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacaacaaccacaaccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctacttagcattcagtttttagattatcattgcacacatatacccagcatatgtctaatatacatgtaaaaatccatgaagcaagtgttatattagcttgtgttttctattgtattaaatttttctcttatatcgtcttctcctttttgtcattaaaaatctgttcaagtcagtcaattaattattggatcataagtagataaagtcttttatttcataacacattgactcaatgaatatgtttctttgcaagacacagtcctcatttccaagaaaacaagcctgaaaagattatactggagcaagtctacaagtaatgatggtagtttttccttattgtcagtcctggggcaagaataacataaaagataacaaggtagaataaagattacataagaaagaaggacagcaacaggacatgggaactatttatagggtaacatttaaataatggatgatgagaagtaatgcgttagacagggatggatgggaatgattgaaggtctgagtactttagcacagattaagatcaaatcattaggattttaagagttgtgtacagttactgaagaaaatgccttagaatttaatttgactgtggataaaacattcttggattagatttaagactattttccatggtaagtatatttataatgatgatgactgtagtgctgaacatttaaacaatgaaaacaaaattaattgccacacacataatgtcctgaatactactgtaaatgttttatcttattttctttaaactgtctacagcactgtaaggcaggtaccactattgtcacagttacacagatatggaaaccgagacacagggaagttaagttacttgattaatttcaagcaatcgggaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccgaggtgggtggatcaccaggtcaggagatcgagaccaccctggctaacacggtgaaaccccgtctctactaaaaatacaaaaaattagctgggcgtggtggcaggcgcctgtagtcccaggcactcgggaggctgaggcaggagaatggcgtgaacccgggaggcagagcttgcagtgagtggagatcgcaccactgccctctagcctggaagacagagcgagactccgtctcaaaaaaaaaaaaaaaaaatgtgtatctggaagattaagttctaacagactcttcatttccatagatccaataatgcacttagggagatgactgggcatattgaggacaggaagagagaaatgaaaacacagccttttatattgttcttaacagacttgtgccaaacattatacgggtgtatttaggtgattgaagagaagaaaggcacaggagtgaaattctgtgagcacaagggaggagttctacactcagactgagccaacagacttttctgacctgacaaccaaggcggcgcaggatgctcagtgcagagaggaagaagcaggtggtatctgcagctggaagcccagctcccaccccagctgctttgcatgtccctcccagctgccctaccttccagggcccatatcaatgcctgggtcagagccctggggaggaactgctcagttaggacccagacggaaccatggaagccccagcacagcttctcttcctcctgctactctggctcccaggtgaggggaatatgaggtggttttgcacatcagtgaaaactccatcaggagttttctctgatcagcaagaaatataattaaaattcaaagtagatcaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggccactcagttttagcgtctctgctctatttggacattttgcagttctaaaaaaaaatcattgaataatttggactttgattcttggactctcttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcagtaaaagctgttcatgtgaagatactaccatggctgaataaatcccattctttttctttcttcaggctatcaacatttcagtggcaaatggttattatggaaacatttgccatttaaaagtgaactaaattatttcttcaattttctctgtgatgcagtagactgtaaaaagattaaagtttgttaaaataaagtacatattcgataaggaagaaatagattattcctaatgacgtctgcaatgacctagtagaaggagtgatagaagcagttgttttcattatttttgtccaaaacttccttccaaatgggatttcattgatcatattcatttattaccacctataagacatgttgacattatgtaacatctgatgtgaagcgctgaggatacatctgtctgtattattcttgccaaaaattaatggtgtgaattgaatcagtagtaaacatcatatacaaacccaactaggaggacattcttcaacatacctggacagtaaacttcaaatgtttgaaggccatgaaagagaaacaaaagtgaaaaactatcacagatttaaagatattaaggacaggataaccaaataaaatacagaaacctgaattttatcttgtaacataaaaaaagtcatcaacgggaaaaatcagtgaaatccatatggtattttaaatgagttaacaaataacattatatctatgttcatttcatggttgtgatacttatgctgtggttatttatgatgctgacattagagcaagctgaaagaggcacatatgggaatcatttttactatatttttcaaattttaggtctaaaagtatttcacctctctcctgcatcctgggattgcctccaattaactacctgcttacaagacttttctttattttctttttgccttttattctttacatgtaaaagatgagtccatctggagcttattttaaagcacagtatgaggactgacattgacctgtttttttaaatgaaataactagctgtcccaaccctgcttgttggataacactgctctgtttcaggagtacccccactgtcatacacccgtgggtccatacccctgggctctccatctgggcactcccctgcctgtggcacctccttcctgagggccggcctcacccagggcccagctgccctctccatggcctgtgtcttcctttcctgatgcctcagatttcccccattctctggcactctttccatcctcctggcctcactctgcacctcccctgaggtgcaggactgccctgccccagcccccagcttcctcactcccaaagccttgtgccactgaagcacgagctccagagtgcacctggatggcagcttctctcctggccaacaaacgcctggtgctggctgccctcccagcatctcccctcaactcctcagctccaccccagggccttaacacacacatgcatagcacacacacatacaaacatatgcacacacagacatgcacacaaatgtacatacggacttacacagacacatacaaatgtgcacacactcgtgcatacacagatgtgttcatgcaaacacacacgtgcacgctcacaggcacgtacacatgtgtaggttatgctaagaaatccattttgtgtggaagacactcaggctcaaatatgtgtccaaagtcacacagctatggagcggcagaactcaggtctctagtgcacacagccccgacttaccgcagttccacttaacagttttcaactttatagtgatgcaaaagccatccacagtcagcagaaaccctcgtgtgagtcccacacggccagtttttcgctttcagtacagcagtcaatgattacatgaggtatccgacacttgactacaaaacaggcttcgtgttgatgcttctgcccaccgcaggctcagggcagtgttctcagcaggccaaggtgggcccccccacgctgtgctattcggtagtcaggtggactcagtcattttccactcgcagcggccttatcgggccgcagccaggggtaagttgagcagtgtctgtacttttagctccaccctgggtatttttaagtggcagatttacaacaaaaaataaaaataaaaatgaaaaaatacagcgttccaaatagtaggggcataaaaggagagaatgcacgttgcggtcagcccatgcctgggagcataagcacttcagaggcatcaccaggcgtgactggctgttgttcctgctcttcctggcagcagcggcctgggcctgagagggatcgccctggccacagctgtaggcaaggctgctgggagccaggagccgccgcgctccgcggtagcgagtctgcggcgccacctcgtgggtgctgcgtggaactccccgtggtgcgggccgggaaggccgggtccccacaaagccggagcccgagcacagcggtgcgagctcgccccaggacatcccacagcacccggagacgggggctggtcccccaaaaccctcaggggtgagaggaaggaggtccccagcctgctgagagctgtcctctgagcacgcactcgcgcacactcacacgtgcatgtgtgcatcctcaggcaccctgacgcgttcacatgcacgtacacgcgtgtgcacacgcacagtctttcacaagagtatgacgcattcacacaagagtgtgacgcgttcacacgcacgcacactccctctccctcgagcctggaaggtgcactgggctcataggggtggaaacctctaccgcggcagaggcacagcaccagggccaggatgctcgcttttatttcagacgtgaaaaccgaggcccgaaagagacagccagtgtccaaccctgtccaacgtctctgctgattgcgcctcctgtgtgtggccggggccggtgtgagggcagcgggcccaccgcatgcctggcccgccccagggcctcgagccacttcctcaggagctgctggcagctgcagcgacggcgcacccagagcccgagggtcccatggagccaggcttcccagcacacaggcacggtggagcctcggggtgggcatacaccccgcgagctcgcgggggctgggcactgcgggtcctcgggtggggactctggagttcagtcttgaaggacacagtcactgagggtcagggaaccaggagggtagggagggtagggaggggtgcctaggcctagtgggagaagcatgtgaaagttccctaagagggctgggggtgaacaagctctcggcccggcctctccgggtagactgctctggtgccctggagcctcccttctccaaggccccatggacgcccccagaggggtgacgccctcgcccacgctgagctctgagtgctgcacgagaactcccagagccgtgtgcacacgcactccccttgttataaccggcattaagtgcactcacattgtcgcatatcccctaccaccgtccatctccagaacttcttcatcttcccaaaaggaaaccatacccactgaacaccaactccctccttttgttaaccattgctctttctgtatttgaatttgcccattctgggcccctcatgtaagtgaaatcgcaatgtatttgtccttttgtggctggcttattccatctagcacaatgtcctcaaggttcatgcgtgttggcacacctctcagaatttccctcctggctgggtgatattataggctcacgcctattatcctagctgttagggagacagaggtaggaagatagcttgaacccaggagttcgagacctgcctgggcaatatagcgagaccgcattttccacaaaaagaaagaaaaaaaagaatctccttcctggtaaaggttcagtaacagtctactgtatgcataaccacatttcgcttgcccatccactcacccatagaccctcagaatgcttctaccttttgactcttgtgaatcacgctgctttgaacatgggtgtgcaaatatctgtgagagagcctgctctcaaaaaaatccatattcttggcaccatgaagaatcacctctcacagacaccagcgaaaagcaagtctgtctgagagcagagggtgaggaggggaaagccgggctgcggatcacagtgggcggaggaaagcccacccttgtgctcccatgtgtgggaggagagaggagagatgccctctagtgaaggaactcttgtagcagccagctccattcctgcttggcctgtggagggccagctcaggaacccagaccaggaagaagtcaaatgaccgacaagatccatcaggaagcagaagtgtgctgtgtctcatcggcaacaacaaacagagctaggaccagccacccaccccccaacccaggggaaatgcatccaccacacaactaccaccgctgcgctcatgacactctcagagacaggcacgggagctcctggcaaggcacaaccagggcaagtgacagtttgccagtcctgggcaagcagacacttatcctctctccagtccccaatcccaccagcctgcacaagcagagaaacatcctgcataaattaaaagatcatccggatcatcaaaagatctgagcaaacaaaacgactgagacaaaaaacaaacaaaacaaaacaaacaaaaaacagaacaacaacaacagaagaacactcatttttacagagagatttgagcccatcccaacagagtacaatgctctttccaagctcatggatggcgtttgggaaaatttagctgtgctaaaggagcaggaagcctcagcccctttcccaagaattgctgttacacaaatcacattctctcaccagggtgcaacaaaattagaaacatgcaataacaaagaccatgttaaaagtgcattttggggccgggcacggtggctcatgcctgtaatcgcagcactttgagaggctgaagcgggtggatcaccccaggtcaggagatcgagaccagcctgggcaacatgacgaaaccctgtctctactaaaaatacaaaaaattagccaggcatagtggcaagagcctgtaaacccggctactagggaggctgaggcaacaaaatcacctaaacttaggaggcagaggttgcagtgagatgagattgtgctactgcactccagcctgagtgacagagtgaaactctgtctcaaaaaagaagaaaaagtgtgttttggaaacaaagttagttttcacaatgaaaattataaaatgcctggaactcaatagcaatagggtattacatattaaaattatgaaactcaacaaaattgacatttagggagaaatttatatcctcagattaatttgtcagaaacaggataaaaggagaaagctcatgataatttgagtaaaagagaaaataaaaactaaaatgaaaaacttttcagaaacaaactacaataagtgtgtgacctatcaaaatctctggatgtgtccaaagcagttctcaggggaaacgttatagctggaagtgtttgttaatatgcttcaacagaagacatataaaattatataaactaagtaaacatacaagaagcttttttaagggaaacaagaaataaatgtatttaattttaaaacagccataataaaagtagacttgataaataaaacccaaaaccacttctttgaaaagaccgttaaaaaaacctctgagaagtcaagcaaaagagaaagaaaaggcacaaattttaaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaacctgaacaaacagaacaaacagaaatggtaagcaggtgctcgaggggctccatcagcctccagggatgggctgctgtgttagggagggccagagcacaggggaagtggagtgtaattctttctacaagattagcaagctgaacttgaatctcacacacgcacacacaccacagtgacgtggaaagaatccacaggacacttatgagaggtaaaaatagaaagtttctgcacaaaacaatcgtgtgtgtttaaaagataccatgtggcagaaaatagtgatgtttgtttgccagtgtctaggaagaaaccttgaaggcgcacgccagactggcggctgggttggctagggaggagacgatggggtgggagcagctaaggacgacacacactcttttaactctgttcctgcgttgtcgggacgtttacaaactgaagatatatatttttaattaattatttttttttttaaaattttactttaagttctgggatacatgtgcagaacatgtaggtttattacataggtatacatgtgccatggtggtttgctgcacctatcaatttgtcatctaggttttaagccctgcatgcattaggtatttgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcatttccacaatacaaaaaattaaaacaaaaaaatcaaaataaaaaaatggctatagaaagttcttatgcagaagggatgaatatgggactatgggaggagggacaaaggaaagacgagaaatgtggatacatacgcgagacaatccacagttcttaaaatcacatctgacgactgaaacaaaaactataccaccacctaatactcaagccagtgatttatacaagtggaaaaggtaaagagacataaatgcaaggcaggtttccacactttgaagtggtaaatactggtaccagtagactactatattacaatacacatattgtaacatccagagcaaacactttaagactatacaaagagatacacgcaacaacattttacagaaatagatcaagatggagggaaagaaaaaggaaacaaaaaagcaaataataaaaacatcaggcataagcaattatgtaacaataagcaccttaaatgtaaatggtctaaataaaccaaaagacagattgatggagagcctataataaacacatggcccaactaaatactgttcatgagaaacttcaaactcacttaaggacctaagtaggttgaaagtaaaagaatggagaaagatatcctgtgaaatcattaattttttaaggaagcaggagtgactatattaatatttcatgaagtagacttcaagcaaaataatttaccagagctggagagggtcttcgctgaattttaagatctaaaatttcctatgctgccttgacatctttgagcctcacagggccccaaaggcctagccgtgggttttcctgtttctaccagacaccccctaccccgccacccaacaggaaaggctccccacctggctagttcttttatcagccagaacagttgcacctcagcctaagaagtttcgcttcacctgtctgccagcccatgaatttattcaaacaagccaattgcattccccctcgggaaccattggtcatcgtgtgctcttgttactaccaagcccgcctgcttcctcagcccgcagccctcactccactacagagtgcggtgcccatctgaccctgtgtggcatgcagtgtcctcctccgagctgtgggtatatgcgactaaaacactgctgtcaatctcatccatccacgccaggtgtcatgttcggccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaaaacaaaggatagcttgaggccaggagttcgagcctgggcaacatagcaaggcctcatctctccaaaaaattttaaatttagccaggtgtggcggcacacacctatagtaccagctactcaggagattaagccagggggagtacttgaccctaggaagtcaaggctgcagtgagtcatgttcgtgccaccgcactctagtgtaagtgacagagtgaaactaggcagaaaaggagcaaggatttacaaaagatctgaacagtcaaccagcaaaatctgacatccgtataacaccccactccccaacagcaaaacacacacatttttaaagccaatagaaatctaccaagatgaggtacacttggggcaataaaagaactcacagcaaatctcgctgtgtgcccctctgcgccggcgccgtgcccctctctgcgccttcttttctcaccatggggaagcgtttgggggcctcttgagggaccccctagatgcttctactcagagcccccaaagccggggagcctccactcctctgtctgcagcctcccctgtcggttctcgctacccagggttcagtggcctgggggtgacggagggggtcgcctctgccaaggcccctcccggcgcctccctggctcatctagcccaccttcctcccacgctggctcacgcaaagtgctctggtcaccaggagcccttcctgaccagccccagccccttcttggccttcgcccacctggcctcccctggagccctgacctgggtgccgggcctgctgggtccagagcccaccccgccctgaacaaccccgagtctcagccaccctcggttcttaccctttcacagctggggagtggagcctgggcctgcacctctccgcgccagagccggcgccagcgcctctccgcgcctgcgccgccgctgcgcgcctcgccgccgctgtctgcctctccgccgctgtccgtctctccgccgcgccgccgctgtccgcctctccgccgcgccgccgctgtccgcctctccgccgctgtccgtctctccgccgcgccgccgctgtccgcctctccgccgctgtccacctctccgccgctgtccgcctctccgccgcgccgccgctgtccgcctctccgccgctatccgtctctccgccgcgccgccgctgtccgcctctccgccgctgtccgtctctccgccgcgccgccgctgtccgcctctccgccgctgtccgcctctccgccgctgtccgtctctccgccgcgccgccgctgtccgcctctccgccgctatccgcctctccgccgcgccgccgctggccgcctctccgccgccgtccgcctctccgccacgccggcgccagcgctgtgtgcctttgcgagggcggagctgcgttctcctcagcacagacccggagagcattgcgagggcggagctgagttctcctctgcacacacttcggagatacagcgaaggcagagcaatgttctcctcagcagagacccgggcgggcgggccggtggcaccgcgagggcggagctgcgttctgctctgcacagaccttgggggcactgcctcgctttgggacaactcggggccgcatggacggtgaataaaatccttcctgtttgcagccctgtttgtggttggtggcagcgatggacactgcagccagccagagcgtagaaaggcgtcggggtaagtgcgctatccaggctgcactgtgggtggcctgggacgggttgggagccctatctcaggcgtcactgcccgtcttgggtggccggttgggtgtgctatctggggctgtgctgcctgcaccgggcggggggtggggggtggtttgggggccaaaccggggctgcactgcctttggtggggagccggttgggggcactatcccagactgtattgctggcaacagtgaggtgggctaagtgtgctatccggggctgcactgtgcggctgtcgggggggtggcggtttcgggttgagggcgctatggggtgctgtaatgcccatggtgtggggaggcggggcagtttgggtatgttgggtgtgctattgggggggtgacactgctggtggtagggggcagggtgggttgggggccatatcaggggctgcactgatggctttagctaggatttctggtactatgttaaacaacagtggtgacagggggcatccttatcatgttccagatcttagaggaaaagctttccatttttccccattccatatgattctagctgtgggtgtctttcctgtagtttttattatgttgcggtatgtttcttctgtgcccgtttctttgaggatttatagcatgaagggatgttgaatttcatcaaatgctttttcggtttcagttgacgtgatgatactgtttttgtcgtttatttggttgatatgatgtatcacattgtatgttgagtgacccttgggtcccagggatacatcccacttgatcatgatgaattatctttctaatgtattactgaatttgattcactggtattttgttgaggatttttgcatccatattagagatcctggcctgtagtttccttctttgatgcttttgtctgattttggtatcacagtaataatggtctcacagaataagtttggaagtattccctcctgtttttcaaaatagtttgagcaggattcgtactaggtctttaaattgtttggtgtgaagccatcagcagtgaagacatcagttcctgggcttttctttactgggagactttttctgatggcttcaatctcattacttgttaccaatctgttctggtcttggatgttttcattgtttaacctaagtaggttgtatgcatctaggaatttgccaatttctactaggctttccaatttattggcatatagtagccagttatgatcctttgaatttctgaagtattagttgtaatgtctccttttttaatctgttgattttatttatttgaatcttgtctcttttcttagcctggttaaaagtttgtcaattttgtttagctttccagaaaaccaacttttcatttaatcttgtatgttttttatttcaattttgtttgtgctacgatcttatttattttcttattttcggtttagtttgttctttactagttctttaagatgtattatttgaaggttttcttttgtttggatggtaggcacttatagctgtaaatctctgcctttgtactgctttctgcataacaagttttggtatactgtgttttcattaccctttgtttcatgaaatttttgaatttctgtcttagtatcttcattgatccgctagtcatttattcaggagggtagtgtttaacttccatgtgattgtattgtttccaaaattgcttttcttattgatacctagttttattcctttgtagtgaaagaagatggccacggagacagacagcagcgtggtcagagtggtaggagccggccatcagcgagagctgctccatgcctggctgctgggtcctagagcctgtggcccactggcttgcctcactgtggttggtggtggtggtgacagagactgcaggacgaccagatggtaggacaggggctatccagggctgcacctttcgcagtgtggggtgggttgagggcgctatccagggtgtcattgcctgcattaggggtactggttggtagcactgtacagggctgcactgcccacggcagggagggtgggttatgggtgctttctggggctgcaatgcccatggaggaggacaggttagggcactatcggttatacgctactggcggcattgggggacggaggtggggggcgctattgagggcaggactagcagtggagcgggggcgagttcggtgctatcaggggctgcactgctggtgtcggtcaacagagttggcatcccaggaaggagtggttctcctctccctgactccacactccagagggcgacccactcttggtcatactggagtgcagcagggcacgcagcgtttgcgtgggaatcctgagcatggcagagcccccacacccaccgtggttcctggttcctgggcctgtgtactgtgggtctgtgcctcagaggctgccaggcacccctggggacaccacgggggacagggccctgtgcgtggaggcgtccggaacaggaattggcacctgggtgtggagggctggctgggtctgaatttttctgcttctcctgctccccgaggagtgcagccccagtgggcccaatggttcctgtggagtggggagctgggtgctgtggtgtctccagcacccaccccagaccccagttcctgcccagcttgggccaaaaggagaggctggactttggagggtgggtgtgagtgcctttgctgaaactggcccctgccacccagtggccggcatgacaagttgaggctctaacccttccacccctcacgtctttctctaggcttttctggctttgcccgcccagctgctctgtgccaggaagaggaggagacacctagagcctgcgacaccatggctcgcctcgctgcgggtgggcggcagtgacggagactgcagtgcgccagagcggtaggagagcggctgcgctaggagggcaggcggctgcagccagggttgggggtcaggcttagagcgatggacgggctgcagcagtggccagatggtaggagccttgtaaggagggctggtgcattggcaatgggcctggctttgccctgcgcctgccgtggatctggccctgtactgccctgccttgccctgtacctgccctactgttacttggactctcggccctgtcctgctctggtcccatcctgaccctgtcttggccctgtgctaccctgtccctgccctggtcttgccctggcactggctctgccctgaacctgcactggcctgaccttggctctggccgtggctctggccctgcctcttgtcctgaccctggtcgtgtcatggcactggccctgccaatggtcatggtcctgctcctgttctggccctgacctggccttggacatgtcctggccctgctttggcccatccctgccctggccccaccatgggcctgcctgttctgccctctcctggcactgaccttgccctgtcatggcccagtggtgccattgccctgccttaccctgcgctggttgtgacttggccccgcttggtgctggccgctccctggacctgccctggacctgccctgaccctgcccttggcttttgccctgccctcactgtggcctggccctggccctagccctggtcctgccatatccctggccctgcccttatccaggccctgcccctgctgctgccctggccctggcctggaacctggtcctgtcaaggacctgccctgactctgccatggccctggccctgctctgccttgttcctggccctgacccagacccagaccctttcctggctctgcactggactttccctggccctgagctggcaatggtctgcccctggtcttgccatcaccctgccctgctgcgctctggatgtgtcatcaccctgccctggccctactctgcctttgaccctgccctggccttaccttggccctcaccctagtcttcgctagaccctgctctggagctggccctagcacagacctggccctgatcctggccgtggtctttgtcctgccatagccctggccctgaagtggacttggaggtgtcctggccccggcataacatggctctgcattggcctgtccctgccctgccgctaccatctccttgccctgctctgtcctgtcccagtactgtcccggccgtgctatttcccttccctaccctgccttggctgtgccctggctcggttctggccctggccccggccctgccctggacatgctctgacactgcctcagcctcggcactagcctggctctttcttggcatcagctctgctctctctgtggaccggctcttgtcctgtcctgcactggccataccatgccctgccctgccctgccctgactcagtcctggctcagccctggcccaaccttggccttggcattgcccctggtcatgccatatttcttgccctgtccctaccctggccttggccctgacccttaccttgctgtggccctgcccttgccctaacgcagcccctggccctgtcatggccctgccctggacctgtcctggccctggcccttccctgcttgagaacttgccctggttctcccctggccctgaccctgaaatgcctggccctaccctggccttgcactgctctggcccttgccctgactctggtcctgtcactggcctagccccagccctgttgctggtcttaccatggcccagaccctgccttggccctgccctgacactgtcctggaccctggctgtgccaagaacctgcactgtccttgccattgttttgctcctgccccgaacctggtcttccccaggccgtggccgtggccctggccctggccctgcccaggtcttggcactgtcctggccccgccctgccctggccctatgctttcctggccctgccttgccggccctggccctgccttggccctagcctggctttgaccctgccctggccctaccttggccttcaccctagccttacctgggcactgtgttggacctggccatagcacagacctggttgtggccctggtcctgccgtggccctgtctcagaccctagccctgccaggtacctgtcctggcccagctctgggcctggctttgtccctggttcttagatgaacctggtcctgctcctgcccttgctcttgccctggaactggccttggacatgtccatggtcctaaccctggccctgcccaggagctgccactgtcttggctgtgccctggctctggccctgccccggccccaaccatagacctgccctggttggtcgtgaactaccttaaccctgtgctaccctgggcctgctccaccctgccctggccctgccctccctttggccctgccctgaccctgccttggccctcacactggccctagcacagacctggtcctatgtgtggccttggcctggcattgacccctgctcctgaccccggtcctgccatggccctggccctgccaatgaccctggcagccctggccctgtcttggccctggccctgaactggccctgccctgaccctggccctgaagtggatttgcaggtgtcttgtccctgatgtaacctggtcttaccatggccctgtccctcccctggctctgtcctggccttctgctgaccctgacccagaccttggccctgccccagccttgtcctagatctggccatggccctgcgtctgccctggaccagcgctggcactggcatggaccctggccctggcccttcgctacttaaggccatgccctggcccagccctggtcctgaccctgtcctggccctaatttggcgtggctctaccctggcatgctattctggccctagccctgaccctgtccctgtccctgtcctggccccagccccattgctggtcctgccacggcccttgtcctgacattgccctttcctggttctggccctggccctgtcccagccctgctctggccctggtctgaaccctggccctgcaatagacctgccttggtcctgcccagaccctggctctggccctacctctgccctggccatacccttgccctggcctggaccccagtcctggtccttgtcctgccccagccgtggccctggccctgccctgcctgtgccctgttctatcctgggctggccctgccatggcctggtcttgccattgccctgccctagcctgccctgcttgtgccctagacctgccccggcctttgcccctgtcttggttctagccttgactgagccctggaccttccctgatcttgcctcagccctggcactaccctggccttgccttggcatttgccttactctctctatggcctggctctggtcctgccctgctctgctcttgttctgtcctggcacagccctggccctggccctggccctgccgtatcactggctctggtcctgcccttatgcagacctgaccctgccactgccttggctttggcctggaccttggccatacagtgaccctgccatgaccctttcctggccctggcctggaacctggccctgccaaggactcgccctggctctgtcatggccctggccctttcctggatttgggtgtgtcctgtcccttatttgccctggcccttccctggctctgccataccccttctctggggtagggccagggtcaggaccagaccagggcagggtcaggaccagggtagggccatggtaaggcctgaagatgggaagggccagggcagcggctggaccagggaagggtcagggccagggatgtagtaggactaggggcagagccggcactagggctgagccaggacagagcaggagagattacattgggctattacgtaaaatttttattttagatttttaagataactatagtagtagtaatgtctatactatattgtttgtaatagtaataatatttgcagtaatcactaaattttaactaatactatctttgcttccagtagtgttctatgagtataattttatcaatatgttaatatgtgaggcattgattctcacaataattctatgtgctaggtacttaaagcatccccattttccaaatgtaggaaacaggcataaagaagttaaatacttggccagattactcctgtaatcccagcactttgggaggccaaagcaggcagatggcttgagctcaggagtttggaaccagcctgggcaacattgtgaaaccccatctctactaaaaatgcacaaaaagaactaatttaagtttcttgtaggattctggttacaaaacactggtcaaacacacagggcatggatagggcagggccagggacaaggtcaggccaggaaggggccagggccaaggcagggccagagatggacttggaagtgtcctggtctgatttgccctgccccaacgttggcccagccctgctctggcacttcctgtcatgccctgtccctggcctgagcactggccctggccctgtcctgcttctggccctgccccggagttgaccaggcactgccatggcccagtcctgcattgccctgccctcctctgccctggtgctaccatggccctgcttgggccctagctctgcctctactctggacctgccctgactctgctcagccctggatctaccctgactctgccttggtgttgccctcccatctctatggcctggctctggctgtgccttgcatagatcatgctctgccctgcgtgtcccagcctgggcccagcccttgtcctaccatattcctgaccccagccatacccttcttctggccgtgaccctgccgtggccctctcctggcccttccttggtcctgccctgcccttccatgccctggccttgccctcaccctgcattggccctgcactggtcctgccctgccctggcactgccttggccccggccctgccttctccctggtcttgcctttgccctgccctggcctgaccccaggcctaccgagtccatgaaatggccctggacctgccttgccatcgtctgtcctggccctgtattgtccccaccatgctctggtccagcgcttgccctggccctgttgctagtcctgccactgttatggccctgccctgtttttggccatgccctgtgctaccctagccctgccctgccttggccttggccctaccatggccttctcctaccctggcctggccctacactggccttttctaccctggccttgcccttcccctggtcttgccttgccctggccttgccctgccctggccttggctttgccttatcctggtcctggttctgccctgaccctggccttgctctggatcctctctggttctgctttctccctggccctgcccttgctctggccctgtccctggcccagccttgaccctgaccctggccctgacaatccccaggtctgacactggccatgcttggccctggcccctccttttggccctgccctggccctgccttggccctgtgctatcttagtcctgccctggccctgaactcaccctggccctaccctcaccctacactggccccgccctaccctggccttgccctgccctggccctgcctttggcctgctctggctctggttctgccctggccttgcccttgccctggaccctccctggccatgttttttccatggtccttctctggccttgcccttgccctgtcccctttctggtcctgccatatttctggccctgtcctgtccatgtcctggacctgactctggccctggacctccctgtccctgccctgccataccctggcccgttccttgctctacactgaccctgccctgccttggccctgtgctaccctagccttgccctggccttctgctgaccctgatcctgccatggccctggccctgccatgtccctgccctggccctggttctgccctgcttctggccctggccttggtcctctcatgtccctggccgtgaccctgcccctggtttttctctggccatgaccctgcccctgttctgtcctatccctggccctgtcttagttctgtcctagccctggcttttcacagtactttatgcttagtaagggctccatggtgtctgtgagttgaatgttgtgttcatagtatctgccaaaacagaaagaaaaaaaacaaaatattttgataagaagttaaagctttgtatataatatgccttgaattgtaaatgcctgttattagttgtattacatataggtcatggttttgtacacataactccaaaccattgatactgttaaaagaatatatgaatatatgaaagaatgtgtaaatgtaagaatgtatcagtatctaattacctttccaaattaatttttatttttagctctattagatttttctcagtgtaacaaatgtttattcctatgtaattaagggcgtatttcctgtacagaatattcatattacctaattgaaaattatatgatacaaaaatataatactatttttaggccaggcatggtggctcatacctgtaatcccaacattttgagaggccaagtttggagaatcatttgagtccaggagttgaccagcctgggcaacatagtgagaccttgtccttattaaacaaataaataaataggttgggcactgtggctcatatctgtcatcccagcattttgggttgccagtgcaggaggattgcttgagcccaggaatttgagaccagcctgggcagaatagcaagactccatctctacaaataataaaatattaaccaggtgtggtggtgcgcacctggggtcccagctacctgggaggctaatgtgggaggttttctcgaggctgcagtgaactgtgaatgcaccactgcattccagcctaggccacagaacaggaccttgtctatgaataaagaaataagtaaaaatataaataaaaataagtaaaaagaaatattagtaaatataaatataaatacatataaacataaaaatgcatgcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgatgagatgagatgagatgatgagatgaaatggagagtggaaatgagatgaaatgatgagacgaaatgacaaagctgaaaagaaattgaaaggagatgagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaatgaaataatgaaatgaaataatgaaatgagatgaaatgaaataatgaaaggaaattatgaaatgtaatgaaattgaaatgaaattgaaatgagatgagttgaaatgatgagatgtaatgatgaaatgaaatcatgagatgagatgaaatgagatgaaataatgagatgaaatgagatgatgagatgagatgaaatcatgagatgaaatgatgaaatgaaatgaaatgatggatgaaatgatgagatgaaatgagatgaaatgtaatgagatgaaatgaaatgacataatgaaatgaaataatgaaatgagatgaaatgaaataatgaaatgatgaaataatgaaatgaaaatgaaatggaaatgatgagatgagaagaaatgatgagatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaatgatgagatgaaatgatgagatgagatgagatgatgagatgaaatgatgagatgaactgatgagatgaaatgaaatgaaataatgaaatgaaattgaaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaaatgaggtgaaattaaatgagatgatgaaattaaatgatgaaatgaaataatgaaatggaaatgatgagatgagatgaaatgacgagatgaatgatgagatgaaatgagatgaaatgatgagatgcaatgatgagatgaaatgatgaaatgatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagataaaatgagatgaaatgatgagatgaaatgaaatgatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaactgatgagatgaaatgaaataatgaaatgaaattgaaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgtgatgaaatgaaatgatgagatgaaatgagatgaaatgaaattagacgaaatgtaatgagatgaaatgaaatgacataatgatatgaaaaaatgtaataatgaaatgaggtgaaattaaatgagatgatggaattaaatgatgaaatgaaataatgaaatggaaatgatgagatgagatgagatgaaatgacgagatgaatgatgagatgaaatgagatgaaatgatgagacgcaatgatgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagatgaaatgatgacatgagatgatgacataagatgagatgaaatgtaatgatgatatgagatgaaatgatgagataaaatgctatgaaatgatgagatgaatgatgagatgaaatgatgagatgagatgagatgatgagatgaaatgagatgaatgatgagatgaaatgatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacgaaatgaaaaaatgaaataatgaaatgaggtgaaattaaatgagttgatgaaattaaatgatgaaatgaaataatgaaatgaaataatgaactggaaatgatgagatgagatgacatgacgagatgcatgatgagatgaaatgagatgaaatgatgagatgcaatgatgagatgaaatgatgaaatgatgagatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaataatgacatgagatgaaatgaaatgatgaaatgatgaaataatgaaatgaaaatgaaatggaaatgatgagatgagaagaaatgatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaggtgaaattaaatgagatgatgaaattaaatgatgaaatgaaataatgaaatggaaatgatgagatgaagtgacgagatgaatgatgagatgaaatgagatgaaatgatgagatgcaatgatgagatgaaatgatgaaatgatgagatgagatgaggtgtaatgatgagaggaaatgatgagatgtaatgaaaggagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatcagatgagacgagaagaaatgatgagataaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaatatgatgagatgaaatgagatgaattgaaatgaaatgaaataatgaaataatgaaatgagatgaaatgaaatgatgaaatgatattgaaatgaaattgaaagatgagatgaaatgatgagatgaaatggtgaaatgttgaaatgaaatgatgaaatgaatagatgtgacatgaaatgagctgaaatgatgagatcaaatgaaatgaaatgagattaaatgatgagatgaaaaatgatgagatgaaaaatgatgagatgaaatgctgagatgaaatgagatcagatgaactgagatgagatgagatgaaataatgaaattaggtgaaataatgaaatgatatgaaataatgaaattgaaatgagatgagaagaagtgagatgaaatgttgtaatgaaaggaggaaatgatgagatgaggagatgaaatgatgagatgaattgagatgaaatgagatgaaaaatgatatgaaaaatgatatcaaaaatatgagatgaaatgaaatgagattatatgaaatgacaatgaaataaatgaaattagatgaaatgaaatgaaatagtgaaatgaaatgatgaaatgaaataatgaaaatgaaatggaaatgcgatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagttgtctttgtgttccttaatctgatgagattttcacactctgcacatgataattgttagatttttattgtgttgataaattgtatatcaaataaaaaatgttattacctcttaaattaggatttttaggtgatataggcagaaaggacagcaagtttttataactttgtctaaatgaactttctaaatgcctgagtattaaaagatagcatgtctataaatcacaatgtatatattactgtatgacctaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaaggaattgctttcttaatttcttgtttcagctagtttactatcaatatatagaaatgctactgatttttgtatgttgatttatatcctgcaactttattaatttcatgtatcaccctaagaagcttttggtagagtcttatttttttccatgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaagctttcaccttttccacactcagcatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaatcagtatatcaaagacttacctgcacccccatgtttattacagcactattcacaatagccaagatatggaatcagcaaaagtgtccatcaacagatgaatggataaagaaatgtgatatacatatataatggaatactatttagtcataataaagaacaaaatcctgttatttgtggcaacaagaatgcaagtggagggtattatgttaggtgaaataaacctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgttgggtgactgtagttaacgggaatttattgtgtgttttcaaataactaaaataaaagattttaaatattctcactgcaaagaaataatacatgatttaggtaatggatatgataatgactctgacttgatctttacgcattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacattcagtaagaatagaaaacttgggcaccgtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataagcttttaatatagtagtcaaagtattaatttctcacattgcaatttccttcaaagacatgaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccaagtagctaggactacaggtacataccacgatgcctggctaatttttgtatttttagtacagtcaagagtttcaccttgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttactttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcacagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcatgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgaatggagttgtacatataatttttatgaaaaaaattaacaagtgcataagttcataatagaaaaaccaataatactccaggcacaagttagtactaaaaaaattatgttgaatattctctaatacaacatgctttttcccttcatgaacaatttgtgttttactgagaagagtcactgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgcaatgtactatgtttatctgggttttgaaaagtgatgtttcctaatatgagaaagccatttacagttttaaatctacaaaggcaaatggaatggtactaaattatttacataataatgtttagatggtggcccttataacattctttctatacttcctacagagttggggatatgcaatcctagaatatttctgggagctaatcctttagcttgatgaatgaaacaagacttttaaataaaattaaactttcaaattatccaggtaatgggcctgtcttttaattcaatggatatggagcataatgaattaacccctgttcattgggtaataagttctcattcttataatactcaaaatgtcctttaatttttaatttttgatagtcatatcattatccctaggtattttagcttctatcttaaattctaaaataattttgaaataggagaaagtattctttattactatatgtattaaacatcatggttttcaaattgaactgcaaatgtatcttttcattgcttcttgatgacacccttcaccctatccatattgtcactaccaagtggtgattacttttcaggttcacatacttattcttcagaaaaatcttctctgtgccttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttataaactccttagacactttttattctgagagaaataaaaaagctaaaagtcaaatgactttttttactctccttattataagcacccatcttggtaatttagggtctttatagttagggtaagttgtgtcataccgaggttacaaaataaaaagtattttgtctttttgggcctttccttattcagtaatactgtcagtttggctttttttgtaggtcaacttattgaactcagtattctgaaataatatgtttactatcttttgagaagcacttaaaatattagatttattgttactcttctgcctttattgggctggaagaataattgtttcactccacaaaaggcaagttgcggagaaaaacacatagacattcaaccgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaagtatataaataggtgacctaatgttaatttttattgtctgagaccatgtctgttatttcactctttaaattcagttagtagtgcagaacctagcacttagtagatactcaaaaattatttgctgaataaaaaaaggttaaacatgtaatatatacaaaatgtactggaaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatgtagtcaaatatccccttggaaaaaaattaagtggcctctaaagtgaggtattcatatatgtaattttacaatcctctagtgatagaattaattaaatacaccaccaaattgattaattcctactgtgttaaaagagaagcactaacaatgccagttaccatgtaacatggatttaagctacaagtcatagaaatgtgatgagaagcctcagcgctgtaaaacagagggtggaggaaagcttttcctctctcaaatgagctttgcgaggtatacttcttgaaggataggaagttgaagtgttcaggacttttatgtctattctactttggcttagtttacatgattcgtagtttattagcctagaaatggccaagaaaacttaaggttcaataattagttataaatatgaaatatccccgatttttaagataaaaacaacttataaatgtatttgtctgtaaaaattgtgtatatttttacagaacatctatttctttttttatttttttatatttatttattatgctttaaattctagggtacacatgcacagtgtgcaggtttgttgcatatgtatccatgtgccatgttggtgtgctgcacccattaactcatcatttatattaggcatatctcctaatgctatccctcccccctccccccaccccacaacaggccctggtgtgtgatgttccccttcctgtgtccaagtgttctcattgttcaattcccacctatgagtgagaacatgtggtgtttggttttttgtccttgcgatagtttgctgagaatgatggtttccagcttcatccatgcccctacaaaggacatgaactcatcattttttatggatgcctagtattccatggtgtatatgtgccacatgttcttcatccagtctatcattgttggacatttgggttggttccaagtctttgctattgtgaatagtgctgcaataaacatacgtgtgcatgtgtctttatagcagcacaatttataatcctttgggtatatactcagtagtgggatggctgggtcaaatggtatctctagttctagatccctgaggaatggccacactgtcttccacaatggttgaactagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatgggtctatttctttaaaacaaagggaggggagtctctcatttgcattagtttttttcatagccttttgaacttcacaatttctatgtttcagaacctatttcttacagtttttctatgctaaactctgtcctagtcagttctagagtgtatgaagaaccaaatgatgtaatagtatgccacctggctgtagtggaacaaatttgactcttaagtatgcaggctctaattttcctgtctggttttggcaagtattccttacataggttttttctttgaaaatctgggattgagaggttgatgaatgaaaattaatcctttcacttttttgtatataggtttgcaataattaggtcagagtggagttttaaggtcacggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacttattactggaatgtgttttaaaggatcatatcagatgaatgaaaggtatttgatccttcgtttccttaataataaaatgatggtttggaaaaataggctacagtctaaccacagtgctattattaggctttcttgttaaacataggtctaagcctaagtatgtcaatacaacaaatacttactgtttcatttctagtaatgaaaaaaaaaaaaaaaacaagtctttctggcataaggatgattttcatctggttattttgaaacatttttgtaaaataaatttccatctataaagaacatttttatttgtaaggaggggtatgtctctgtgcactggaagagagggaggactaaatcactgggaagtcttatgataaagaagccattggcttaaatcagcgaagcaagccgtcccttggtttaaggtgtttttcctggccatcctgtcttgactagaactttacctacaccttcctttttggtttaggcaaattatagtatctaaaactaaagtctcagctctgtgtctttgacatataaatgttctaccatgtcttctctggaatctgataactatctatctctttaaaatgcaagtctagggagatgactcatcagaaaaagaagaaaaaagaggtatttggaaattgtgcaaattaaagcagcccctgatgtcaaagtctacacattcctgagtgagtcagttctggccagttctagctggatcaagagagctcttctgggcaggcctgaagagcacctgaatggcagccacctgaggagccaggtgcctgaaacttccttcacctgcttgaggagcgccaaagcccaggtgctggctggacaaccacttctggctgcctaagcagatggcagaagaaggaaacaaggtcagaggcagagtattgaaccctgcctcccaggtgggtggaagatgcctgtcgccaaactagggcccagcttgccgggtgagatgggtgaactggtgatcccccgagagagtggacgtcagaactacatgttcctggacttcacctcggccagcgaaggagagagagggttaatgttaactgcacgaggcccactctagccttaaattctgtaattcaaacccttcccttggagacaaaacaaacatgacaaggaattctgaggtcaggggacaagaatcacaaagtgggagattgaggaggcagtgtccttcctgcccttggtctactggctaagaaccttcctcagcctgacctttgcacattgcactttcagctctgtttgcaattttcctcctttagtgctgagggaatcccagtgttccatcctgaaatctataggttcctaatgggtggttaaaaaaaaacctcagcgagagaagcagaaaatgtttcctcttcctgaaaaactgtagaaaggcaggcaccattctgggtgaggacatggtccttgcaaatgtctttgtgttgtttttgtttttgttcttgtttttgagatgaagttttgctcttgttgcccagactggagtgcagtggtgtgatctctgctcattgcaacctccgcctcctgggttcaagcagttctcctacctcagcctcccgagtagctggaattacaggcacctgccaccacacctggctaattttttgtatttttagtagagatggggttttgccgtgttggccatgttggtctcgaactcctgacctcaagtgagccacccgcttctgcctcccaaagtgctgggattacaggagtgagccaccgcgtccagcctgcaaacgtctttaaagacagcgtgtttcagaggctgtgacagtgccctgtgaacatgccaattctcacagtcccgggagctctgaggagcaggcccggctccttgccaggctgatggtactgaaactctgctctccaagacataacctgatggccatgcaagatttcttaatcgactgtggaccgtgagagtctgcatctcattttaattaagatgggaaaagaaagaacaaaagagcaactcccaggttatagagaaagtggattttagtataatattcaagtgtagcattgctaataataacaaacctttcccctcccaaacggtaaacacttgcactgcctattatacaaaaattcaaccaccctctctgttaccccgatatctcctccccagtgaccccccctctcatgcggcctcatgagcctggccagtggtgaatggcactttcatgggcatgagactccacgtgagtgggactcagctgggacccctctccacgtgggagctggggaagccaccctagtagcagctcaaagtgtccgtgatgtccctgctgctgaggtaggggccgcctctgagctggtctcggggtgtgagctgctgctggtagtgggctctgccctgagggcctggtggctggtcagaagggcaggcacacatgggtgactccccaggaactcaggccacctccccaccacagccctgcactgtgtgctccaggcatgtgctgagtgcctggtcaatcaccagtgccctattgatcccagtctccagagagagcatttagtgtcactccacagaggggaaactcggcccagagaagtaaagtgactctccccagtcacagggctggtcagcagtaggatgggaggctagtcccttgctgtctgactccctgagcccacccatatcccaaggcagccaacctctgcccgccctggttcaggccccgactggcccctgtggtgggtgatgtctatcttcctggcctttgtgctcccagccaactgggatggagcctccagctggcatgacaggttgtagctacggacagaagagtggctgtgaggctgccaggaatctcaccagggccccctcccagggcctgtccagagtgaggtctgggtaccccaggcattgccagaccacaggatctgatgttggccaagaggccatggccacaggctttctgaggctggcccccagggagagttcaatcctactatcccaattcctgtcctggccttacctctcagtctcaccgagccacttcatggtcccaaaccaggacccaaagtgctgcttgggctcaaggttgtaattatttgcagccaactggagcagtggacctccttgcttactttgaattcctgggtccagagggaaaaactgggtgatgacagggactggacagggatgccacaggggccctgtgggggtgttagatggggtggtggccagtctttgctcataggggaccccctcctcctctccagtcctgtccccacctgttctcagagctggctcaaacagcagctcctccaggaatgtgtccttggtttcaacctggtactcccacctgcaggtcttcctggagtgtctcctctttctctctgtctccccataaatctaagacgagggggatggatctgcccactgctactcaccgtatgactcttgtgaggttgatcagtctcccctggaaggccaacagctgaagtccatcagaaagggtcctctggcccagagccagcccctgcccacccctgtcttgctgcacccagggtgcaagacccagatcaggtctgggtgacaggaggggtatagaggggctgaggctcaggggccttctagcctaacttgtctggagacagttggggaaactgagaccccaagcagggaggtatggctccgagagattattctcattaatctggaacatttttgcaagctgttaggtataggaagtctgtcacaggtaagagaaatgctttttaagagcatgagagacagcagggttgtgacaatattgaaacaccaccgtgcagattcaccaattgccaccaccgggagccccctgagagtcattgcagatgcacagccctcccctgcaacccctggacctccccgtggtctggcacctaaagggttatgcctcatggcaggaatcaggaccctcagggtgccctgcccactccaaggtctgcctctgctctgattggtcactgacattcagattgtcacccaaatataaggacattagcagaaagactcattcaatacaagtggactcagacatagataggaattgggttgcaagaagccccttttgtttcttttattttattttggaaaaaacttttattgtgaaaattcacatatatatatatatatatatatatgtatatataaactcaatcaatgcaaaaggatagacaatgaacaaatgaattccccttccactccagatccccaactcagatccagacctcctgagcccacttcccccatctcatcacagatccagacctcctgagcccactttccccatctcatcacagacccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccaactcatcaccagtgatttcttgggctctgcattagttttctattgctgctgcaaccaacagctacagactcagtggcttccatttctgtcttatagttctggttgccaaaagtcctaagaggatctcactgggctaaagtcaaggtgctggcggggctatgtcccttctggaggctcaagggatgaatcgggtccctgccttttctagcttctaggggctccagcttctaggtttgtggcctccttcctccatcctcaaagccagcaacagcaggtgaagtcctcgcccatcatgcatcactctcccttcttcctccttcaacttttttttttatatttagggggaacgagtaccggattcttacatagtcaaaaagctccttatagagaagctcggaactttcaatacaactttgccttttctgccattttaattttccatttaatttaaatgtattctctcatttgaccttcatactctgtggagaaatattcctatttcggcttgtattgacaagctgttttcacacagcccccacatcacccaaccaaccagcaagaaacagataaagaaactgaggcccagggaggctaagagtcctgccaggatcattcacctttcaaggtaaggagccagttccagacctgggtttgtgcagctccaagctcccccgtctttctacaatgctagatttagactatagcaatctagcaagtgtggccacacaatgatcaagttggatttagatgatgttccctataaatccattctcctctcccgtgtaagcaaggcaaagtcctccaggccatggggagtccctgaagactcgatgaactgcagtggccacatcaggaggttgcaggttgaccagaactcaccgacacagcaggagagcagcttggaacctgcaacctagccaaaacctagtgccttggattgggggagaaaacaggcagccattcctctctctctgctggctagaggggattctggcttttcctgccagagccacccctttccctcctcctaaagttgatggtggttctttaaggaaagggagaagtgcacggtgtgatagggcaggaagagaagaaaatggaggagaggaggggactttcccataagcaggcagaagaaaaggcagctgtggtgtgtgatggacatggatgcagtggtgtccaatgtggggtcagccctagaggagagacagagagagagacagaaaagtgagagtcctgacccttacgattaacatgggatctgcctgcaaatgctgtttagggccatcgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagtcttgaccccaatacaggggctggatatgaacaggcaacagctgggtttctgagtcagaaagacttggttaattgctaattgcttaggcgagtaatttaattttgttgagtcagattcttcagctacaaaatgcagatgacagtacttattcctccaggttgtggggaaaatggagattctaagcacgatgtccatttcacagaaaggtaccaatttggtggcttattttcctttctaccttcagaagtggctatccctgccacccaaacagacccttgactctcaagtggacggggtcccatttgcacagggggagaccttacagcctacgttgagtctatacttaccacttagtgagcattgtgtccgctcaggggcctctgtgggcatccgtctcctctgcagcatctttcctccccactgctgggtctgcacatgaccccctccttgggttaggcctctgatcagtgatgaccttggtatggtggtgatggtcagtcttggcatcaaatgagccagtttatatcatcagctattcaataaaatactaatctaggtgtcaccgtgaaagtattttgtgacattgttatgtacgtgttgttacaaatgtgcatgatgcatttactacagcatagaattttgcctgggtgccagcctgaagtctgtccgacagatcatagccatgttagtcccacagtcacaggggccaattgattaaattattttatctcccttgaaaactaaaaataaaatcctaagccccccacccgacttaacagaccccctgttggccaacggaacctcaaataaatcttaaaattcagttcttggccatgacaggacaggaggtcagacatacctccctgtacctccctccctcttatggtttagaccccacaactgaacagcattaatgttaaaatagagatcatgagactgacagaacagactctttgtggcaataagacctcaaattataaacaggagctagggccatgccaggcgagcgttaagtcttgtaccctactcttaaagaattaactagattctaactaccacgtgggttttatttttctctagcaaccaagcaagcactggctgtgagagaagcaagattaaaacaattacaactcacccagttcacagacgctgagtaactgatctcctgccccactaaccttaatgacagctttctctggacaagggactgatttcagtaactttctcctgataagagaccatcctccatggactggttctggccagttttggaggctgtgcctgtacagaggctgagtaccttcatgtccctgcttcactttttgatgtgtagggcctaattataatacatttaaatgtcaagtctccaccccagaatgaacatgcatgtttatggaatatgcatgcattaggacctcttttatgagtattctcataaaatgatatagctcctctgatatcctattgagtatgtatatgtagccaattcatttggctcaaattcctgtcctctccttccctccctggaaatgcctgcctctggccttggctgtaggccacacttcccagcctgtcataatggccaccttgcagactgcaaacctatataagaaataaagctctcttttctaaatttataaaattgtgtgatttttcagttgatgctctctttctacacacacacacacacacacacacacacacgcaatttatacagaaggaaatctggagaatatatgtgggaatggatattaagtgtgtggcaccgtggtggaagtaacataaagttggattaggctaaatttattaatgttggcccactaaacagagattctggactcagggttgtaggtcaaagctttagaaagggctccaagggttggtttgatcggttacttggttggttgcttgcttggttggttggtgcttgcttccttgcttggttgtttggttggtttgttgcttgcttgcttgttggttgattggttggctgtttgcttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactggagggtctacggaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatggtttgactcacagacacccacggcattgtgtagtccatggtatccacagggagagctaatgggctgtaccaaagtcttagttgttctttaaaaaatgaagaattctaggtcaactgaataaaagactaactcaaattaatgaaacacagatctaaaaccctcaatcaattcccagacttgagccagttcacaggcccacaaccccttaagtgaaggggaggctgggtgatcttggggaagtacgctgctacgttgccaaaaatttacattgttaatctttttcccagtcttccccaaagggacttacagccttctgccaggatgactgtgacttaaagaaaagaaaattctcagatatttggggaattactggacactggctctcatttgacactattatcactatgttgcctaggatggattcatgctcctgggttcaagcagtcctcctacctcagcctcccaaagtgctgggattacagacatgagccactgtggccagcagagctttgaaactagaacatggaggtccagtggtaaagatttgacaagtctgggaagagattgggccaaggcaatgttgatgattcttttttttttttttttttttttttttacaacagagtcttgttctgttgtctaggctggagtgcaatggcgcgatctcggctcactgcaacctctgcctccggggtccaagcaattctcctgcctcagcctcctgagtagctgggattacaggtgcccaccaccacaccaggctaattttttatttttttgtgttttttgagacagagtctcactctatatcgcccaggctggagtgcagtggcgcaatctgggctcactgcaaaccccgcctctcaggttcatgccattcttctgcctcagcctcacgagtagctgggactacaggtgcctgccaccgtgcctggctaattttttgtatttttagtagagacggggtttcatttcaccatgttagccaggatggtcttgatctcctgacctcatgatctgcccgcctcggcctcccaaagtgctgggattacagggatgagccaccatgcccagccacaccaagctaatttttgtatttctttttttagttgagacagggtttcaccatgttggccaggctggtccctgaccttgtgatccacccgcctcagcttcccaaagtgctgagatgacaggcatgagccaccgtgcctggccaatgttgatgattctaaacagcagccgttaatgtgaaaaccatccaactggaagccctggccttgcccagaggacacagtctgggtggtgggcagagacttcagctgccttccaaggcaagcagctccttgctgcccgcttgctggggattttacttacagggcagaagctggcaggtgatttgggggcaggaattgcttcctggatggtataggatgaaccacactccccaggaaggcactcatcctggtggcctaacagaagcagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttgttttgttttgttttgttttttgtaatggaatcaacctaggtcctaagcctagcaggttgttattattatttttatgattattttttgagatggagtcccactctgtggtccaggctggagggcagtggcacgatctcagctcactgcaatgtctgcctcctgggttcaagagattctcctgcctcaacctacagaggagccaggattacaggcatgcaccaccatgcccggctaatttttgtacttttagtagagatagggttttgccatgttggccaggctgatctcaaactcctgacctcaggtgatccacgcacctcagcctcccaaactgctgagaatacaggtgtgagctgccatacccagccacaggttatttttgctgatcttctccctcctcccaccctcaaagaaaacgcggtacatctacaccatggactactacgcaaccctgaaaaggaacaaaatcacggttggtttttttttttttttttttgcagcaacatggatgtagctggaggccattatcttttttaattatttttattattttttttctattctactttaagttctggggtatatgtgcagaatgtgcaggattgttacatagatatacatgtgccatagcggtttgctgcacccatcaacccatcatctacattagatatttctcataatgctgtccctttcccagtcccccacccctgcagtaggccccagtgtgtgatgttcccctctctgggttgatgtgttctcattgttcacttcccacttatgagtgagaacatgcactgtttggttttctgctcctgtgtcactttgctgaacatgagggtttccagcttcatccatgtccctgcaaaggacatgaactcatctttttcatggctgcatagtattccacagtgtctatgtgctacattttctttatccagtctatcactgatgagcatttgggttggttccacatctttgctattgtgaacagtgtggaggccattatcttaagtaaattaatagaatgctgcgtgttctcacttataagtgggagctaaatgttgtgtatatgtagacacagagaagggaacagatattggggtctagttagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccatcatttgcaccagcaattccaagactgggcatctacccaaaggaaaagaagtcattctaccaaaaagacacatgcatggtaaagttccttttttttgtttgttttttgagatggagtctcgctctatttcccatgctggagtgcagtagcaatctcggctcactgcaacctctgcctccagggttcaagtgattctcctgcctcagcctcttgagcagctgggattacaggcatgcgccaccatgcctggctaatttttgtatttttagtagagacagggtttcaccatattgaccaggctggtctcgaactcctgacctcaggtgatctgcccaccttggccctccagagtgctgggattacagtgcctggccctgtaaggttcatcacagcacgacttacaataggaaagtcatggaatcaacctagttgcccatcagtggggtaccggataaagcaaaagtggttcttctacagcatcgaatactacacagccatgaaaaagaacaaaatcatgtcctttgcggccacatggatgtagctggagggcattatgcttaatgaattaacacaagaacagaaaatcaaataccacatgttcttgtctggataaagcaattgtggcccttctacaccatggaatactgcacagccatgaaaaagaataaaatcatgtttttgcagccacgtggacacagctgaagggaattatgcttagtgaattaacgccaggaaaagaaaatcgaataccacatgttctccactagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaacgccaggaacagaaaataaaacaccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttgggtcacggatttttctgttgcattttcttgcttgtttgttttctatctctctctctctcttttttttttttcttttttttgagatggagtctcactctgtgacccaggctggagtgcagtggtgcaatctcggctccctgcaacttctgcctcctggattcaagcaattcttctacctcagcctcccaagtagctgggactacaggcacctgccaccacacctggctaatttttgtatttttagcagagacggggtttcaccatgttggccaggctggtctcgaactcctgacctcaggtgatctgcctgccttggcctcccaaagtgctgggattacaggcatgagccactgcacctggccctcttcttatatatttctagaactcctctcgaatttggggtttgtttttcttaattacaaggaatcaagttgaatcattagtgcatatataaatatacattttattttagtacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcctcacgcccaggggacactcagaatgtcgtttgcagaacacgggttgtttttcttagaaacgccttgcaaaacaaaataggaagcaaaatctttctcactccttccactccataatagacaaaataaaatgagggggcaggaatccagagactttgaccacagttggcagatttattgtggtacagacatgaaggcaagcagtgttctctctgattctacgaaccgtacagcccgggccagctgccttctgctttctggatggtgcaggcgtgagctccaagcccaaatttcactggagctccaagaatcgagcctggcccaggcactcactgcacgggggccaagcgtgaaaccagtgatcgctccagcaaggtaacaggacagcttggtgatccttcttgccggccacaaaaggttatagccagaattccaccgaatgtggtctttctgtgtctctccccagatagtgaagctgcacaaacctgggggtggggggtggggggtgctgacctcagtggggtgtcctggagaggcaggaaccagagtttacagggtgcagatcctactgaagcaaatggacgtggcatccgtgggcagagctggctgtggctggccttccagcctggatgtctcccccccccccgcctggggtgtcaccaaatgcacccagagaccccttctaaacctggggggatgtgctgacctcagtggggtttcctggagaggcaggaagctgggtttccagggtacatatcctactgaagcaaatggacgtggcatccttgggcagagctggctgtggctggccttccagcctggacgtctcccccactgcctggggtgtcaccaaatgcacccagagacctctcttctgaaagcccattcatgggaagcctccaggtctcctcagcaggcagcatcacgtctgatttcactgcgttatcaggtaatgcaggcctgttctacctgtgtgcgtgagcgcgtgtgtgccgtgtgggagtgtgtgtgttgatgtgggtgtgggtgtgtgcttgtgtggctgtgtgtgtgtgcctgtttatgtgatgatgagtgtgtctgtgagtctgtaagacaacgtgtgtttccatgcgtgtttctgtgtgagcgtgcattcctgtgttttatggaagtgtgtttttgtgatggtgtttttgtgtgcacctgcgtttatcgtatttgtgtgtttgtgaatatgagtgtatgtgtgtgaatctgtatggcaatgtagaaattcttttttttttttttttgagacggagtctcgctctgtcacccatactggagtgcaaaggctcaatctcagctcacagcaacctccacctcccgggttcaaacgattcttctgcctcagcctcctgagtacctgggattacagacacccaccgccacatctggctaatttttcttttttgatatggagtctcgttctgtcacccaggctggagtgcagtggcgtgatcttggctcactgcaacctctgcctcccaggttcaaatgattctcctgcctcagcctcctgagtagctgggattacaggcataagccaccacatctggctaatttttgtatttttgagtagagatggggtttcaccatgttggccaggctggtctggaactcccgacctcaagttatctgcccgcctcggcctcccaaagttctgggagtacaggcgtgagccaccttgcccggccccagtgtgtgaatttttatgtttgtgtgtctacatgattatgtgagtctttttgtgactgtgtttccatgagtgtgtgactgtatttatgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcctaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttaatataaacatgatttttatagttcatataaataaagttatatatagtgtatatgtaaaatatacttttatttgtgatacataattttatagattaaattttatatactaagcaaagttacatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgtgtgagtacatcagtgagtgtgtgaatgtgtgtgcatgtgtgcctgtgtttgtgtgagtgtaagagtgttgtacatttatacactcacattttgttttctggttaataacaagatctatctttgatttaggatatgaagaattcttataagcaaccccccacacaaaatttgtatttattttaaaatattcttaaaatatgggttcttttatttttgcacaaacagacaagagtgttttttctttccaaaacttttatttcaaattctgaccctgaggagcagaaaaagaagaaaacattgtgtaaccttatatacattagaaacataagtagttactaaatgcaatacagattttgacaacatgcatttaggaaaaatgaggaattcaaactcgtagctgcctcaatattgaactttctaaagtttaattttttttaattaaaaaatattcatttgggttcaatatgtatggatctccagggcagaaatgtctctccaaaaagtgaaccactctgaaaatcaccgtcatttgggaaagggtgatgccccagctgtcttctgaaaaatagcagaggcttccggccagtggggtgtctctctctttccctgaggccgaaatgtcagggaatttttcttccccacccctaggagcccagtaaatgcagaatatttcagaaggatttgcacagggtcccggcttctgctatttatgagctccatggattcttggctcaggcttgtgatcagctcacctgctccagaatcacttcccatcttagcttctgggctaagacacctcaaaaccagcaaaggaaagtcctcactggtcaacgcgtccatcccaactcccccatctccccttagggtgggtttggggttcgggactgctttactgttcctttcaaagcagactgggaggtaagattttattctgcttccagaggttcaggatttctgcagacggtcagcaactctttgcatcctactggtaaaagttttatatactttgtatttatagaaatacgcattgtgtatattttatatgaatagattgatataaattattttagtaacttaaccatatgacttttatatttttatataaataaagttatatgtagtgtatatgtaaaatacttttatttctaatacataattttatagattaaatttaatatattaagcaaaaatatatgtaacatatataacatataacatcatttctataatatataacttaatgtaaataagtatataaaattgatattatatttgttaatacataattatacatatatactgtgtaaaaataaaattacatattgtatatgcataattatatttctataagtacaattatatactatgtataattatgtataaaataattgtataataaaattatataataaattttgaaacgttataaattattatacatagtattttattgtattaaatttagaaatgtgttatatgtaataaaattttattataataaatgtagattatataaaatcttatttataataaattaccttatgtataattataatatgagaaaataattacatatcattgtattataataaatttagagatgttatacattattacatataaaatttcattatattaaatttagaaatatatgtaataaaatggtattatgttaaaatttttatgtaacattttattatacatgtataattttatataatgttttataatatatagaatataagtacacagaatataagtacaaaaatatttatatacagctacacgtaatataaatacatcagtgtaagatgttttgtgtgtgtgagatggagtctcgctctgttgcccaggctggagtgcagcaacacgatctcgtctcactgcaacctctgcctcctgggttcaagcgattctcctgcctcagcctcccgagtagctgggattacaggcatgcaccaccacacccaatcaatttttgtatttttagtagagatggggtttcactgtgttagccaggatggtctcaaactcctgacctcaggtgatccacccgcctcggcctcccaaagtgctgggattacaggcatgagccacagtgtaagatactagctattaaaaaataaatatatatatatactgcaacagctgatttgtctggaagagtttggtcagaagacagtgtattaagaagactgtgagttcccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacagcataaacataaagtacaaaaatatttgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatattatataattaatatattctatgctatataatatataatatattctatgcaataaaatatatagcatatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatatagcaaccggtgatttgtctggaagactggtcagaagacagtgtattaggaagacaggcagtctccgcaggaagcatggtgcaggtgggatctggaggtgactctgggctgccagaagacgccccactgctttgcggcagacacaggtggagaggtcctctctgtagcttcagcatggacagtgtgtgtgtcttgctgtgggaacacttctttctgcttccctctccactgtgaccccatcacactcactgacctgccctcctccttcctctcgctctccggggcccctgtggaaagagggtcttccctccgtgcagcaggaacccccaggaccatccccatgctcctgggttctgaacttcagggacatatgatcctacctgaccgggcacaggctctgttcaccctcaggaacccctgtcctcccaggccaccgtggactggagaactggcctcctgaaaatccagagagaacttagcactcacaacttctttctttttttcttttttctttgagactggatcttgctcttttccccaggctggagtgcaatggcatgatctcagctcactgcaacctcctcctcccaggttcaagcagttcatcctgcctctgtctcccgagtatctgggatcacagtcatccacccccgcggccaactaatttctgtatttttagtagagacggggtttcaccatgttggccaggctggtctcgaactcttgacctcaagtgatccacccgcctcggcctcccaaagtactgggatgacatatattagcatgatgtatattcttctattcctccggggactcactgtcttcttgggcagtaaaccactgtgcccggacttctctgtccacatctgcacacatctaaacctctgtagattctgaattgtttttccttttgcacagaatgagaggaactgaagtcgggaggcccagccccaacacggtccctgtggctctgtgctcaggtggtttatggctgagaaggacttggggggttgagggcttcctatcagcccaggagacattacctgggtctgggaagcctgctctgcacttgtgggtctcgaattgtctgttgcatttacctgcctcattattttttcttcctgtctctcttcttacatatttctttcgaatttggagcttgtttttcttaactacaatcaacttgaatcattactgcatatataaatataaattttatattgagtagacattatatactcaatctactacacattccaacacgggccatatctaagacgaatatttatatttaatgtttaaaatatgtttacatttcatatagaaaaatatatttatatttaatatatatgtgtatatttaatacaggaaatatatatttatatttaacatataaaaatatatgtttatatttaatatgggaaatatatgctttgtttaatatacataatacatgttgatatttaatatagaaaaggtatagttatatttactatgcaaaatacatgtttatatttaatatagaaaatatgtttatatttaatgtacaggatacatatttacatttaatatagaaaatacatatttatatttaacatacacagtatttatatttaatgtataaaatatgtttacatttaatgtgctgaatatatgcttatatttaatgtctaaaatgtctatatttaatgtactgtatacattaaatgtaccaaatgtattcttatatttaatgtataaaagaagtttatatttaacatataagatatgtttacatttaatgtataaaatgtttatgtttgatgtataaaagatgtttatatttaacgtatacaatttatatttaatgtaccaaatatattattatatttaatgtccaagccagccaagccagtcagccaagccagctaagccacccacccagccaagccagccaagtgagtcagctagccagccagccaagccagccaaaccagccaagccagtcagccagccaagccagccaagccagccagccagccaagccagccaagccagccaagcaagccagccagccaagccagccagccagcccaggagccccagccagccagccaacccaaacagccaagccagccaagccagccagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccagccaagccagacaagccagccaaccagccagacagcccagccagacagccagcccaggcagccaagagacccaagccagccagcgaagctggccaacccagccaagccagtcagccaagtcagccaagccggccacccagccaagccagccaagccagccaagccagtcagccagccagccagccaagccagccaagccagtcagccagccagccagccaagccagccaagcctcccagccagccaaaccagccaagccacccagccagccaagccagccaagccacctagccagccaggcccgccagccagccagccagcgagccaagccagccaagccagccagcctgccaagccagccggccagccaagctagccaatccactcagccactcaagccagccaagtcacccggccatccaagccagccaagccagtcagccagcccagacagccaagccagccaagccagccaagcccgccaaccagccaagacaggcatgctagccaagccagccaggcagcgaagccagccaagccagccagcaagcaaagccaggcatgtcagccaagccagccaggcagccaagccagcaaagccagccaagccagccagccagccaagccaggcatgccagccaagccatccagccagctaagccagccggctagccaagccagccaagccacccggccagccaagccagccagccaagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagcccagacagccaagccagccaagccagccaagcccgccaaccagccaagacaggcatgctagccaagccagccaggcagcgaagccagccaagccagccagcaaggaaagccaggcatgtcagccaagccagccaggcagccaagccagccaagccagccaagccagccagccagccaagccaggcatgccagccaagccatccagccagctaagccagccggctagccaagccagccaagccacccggccagccaagccagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagccagcccagacagccaagccagccaagccagccaagcccgccaaccagccaagacaggcatgctagccaagccagccgggcagccaagccagccaggcagcgaagccagccaagccagccagcaagcaaagccaggcatgccagccaagccagccaaccagccaagccagccagctagccaagccacccagccagccagccagccaaaccagccaagccacccagccagccaagccacccagccagccaagccagccaagccaatcagccagccaggcagccagccacccagccagccaagccagccaagccagccaagccaatcagccagccaggcagccagccacccagccagccaagccagccaagccacctagccagccaggcccgccagccagccagccaggcagccaagccagccaagccagtgaagcccgccagccagccaagacaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagccaagccagccagctagccaagccacccagccagccagccagccaaaccagccaagccacccagccagccaagccacccagccagccaagccagccaagccaatcagccagccaggcagccagccacccaagccagccaagccagccaagccagccaagccacctagccagccaggcccgccagccagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagcccgctggctagccaagccagccaagccacccggccggccaagccagccaagccagccaaccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccagccatccaagccagccaagacagccagccagccaagccagtcaagccagccatacagccaagccagccaagccaggcaagccacccagccagccaagccatctagccatcaagccagtcaggccagccagccagcctgccaagccggccacccaccaagccagccagccatccacgccagccaagccagttagccagccagccaagccacccagccagccaagccagccaagccacacagccagccaagccacccagccagccaagacagccaagccacacagccagccaagccatccagccagccaagacagccaagccagccaagccatccagccagccacgcaagccaagccagccagccagccaagcaatccgtgccagccaagccatccagccagccaagcgaggtgtccggccaagccaccccaccagccaagccagccagccagccagccagccagccaagccacccagccaactaagccagccaaaccacccagccaggcatgccagccaagccacccagccagccaagcctgtcagccagcgaaccagccaagccagccatgccagccagccagccaagccatacaagccagccagccagccatgccaggacgagactccatctcaaaaaaaataaaaaaaaaacagcctggccaacatgatgaaaccccgtctctactaaatgtataaaaaattatctaggcgtggtggcacacgccagtaatcccagctactcgggaggcccaggcaggaggatcgctttaaccagggaggtggaggttgaagcgaaccaagattgcaccacctcattccagcctgggcaacagggtgagactcaatctcagaaaaagaaaaaaaaaaaggccagcctggccaacacggtgaaaccccatctctactaaatatgaaaagaaattagctgggcgtggtggcacatgaatgtaatcccagctactcgggaggcccaggcaggaggatagcttgaaccctgggggtggaggctacagcgagccaagattgcaccactgcactccagcctgggcaacagggcgagactccatctcagaaaaaataaaataaaatagaccagcctggccaacagggtgaaaccccatctctacaaaatatacagaaaaattagctgggggtggtggcacacacctgtaatcccagctactcgggaggcccaggaaggaggatcgcttgaatcagggaggtggaggctgcagcgagccaagattgcaccactgcactccagcctgggcaacagagtgagactccatctgaaaaaacagaagcattccagcctggccaatagagcgagactccatctcaaaaaaaaaaaaaaaaaaaaaaaaaacaccagcctggccaacatggtgaaaccccgtctcttctaaatatacaaaaaaaatagggccaggcgtggtggctcatgcctgtaatcccagcaccttgggaggccgaggtgggtggatcacgaggtcatgagatcgagaccagcctgaccaacatggtgaaaccccgtctctactaaaaatagaaaaattagctggatgtggtggcacatgcctgtaatccctgctactccggaggctgaggcaggagaattgcttgaacctaggaagcggaggttgcagtgagccgagatggcgccactgtactccacggtggtgtcagagtgatactacatctcaaaaaaaaaaaaaatagctgggtttgatggcacacacctgtaataccaggtactcgggaggcccaggcaggatgatcacttgaacccgggagggggtggttgccgtgaaccaagattgtaccactgcactccagcctgggcaacagggcgagactccatctcaggaaaaaaaaaaaaaaaagaccagcctggccaacatggtgaaaccccgtctctactaaatataaaaaaaattacctggatgtggtggcacatgcctgtgatcccagctgctcgggaggcccaggaaggaggatcgcttgaacctgggaggtggaggctgcagcgagccaagattgcaccactgcactccaccctggataacagaattagactctatatgaaaaaaaagaagaactccagccagggcaatagagtgagactccatctcaaaaaaaaaaaaaaaaaaaaaaaaagaccagcctggccaacatggtgaaaccccgtctctactaaatacacaaaaaaattagctgtgcgtggtggcacacgcctgtaatcccagctactcgggaggcctaggcaggaggatcgcttgaacccgggaggtggaggttgcagcgaaccaagattgcaccactgcactccagcctgggcaacagagcgagactccatctcaggaaaaaaaaaaaatatcagcctggctaacatggtgaaaccccgtctctactaaatatacaaaaaaaattagctgggcgtggtggcacacgcctgtaatcccagctacccgggaggcccaggcaagaagatctcttgaacccagaaggtatatgctgcagcgagccaagattgtcccaccgcacttccgcctgggcaacagagcgagactccgtctcagaaaaaaaaaaaaaaaaaaaaaacaagaacaggttggccaacatggtaaaaccatgtctctactaaatatacaaaaaaattagttaggcatggtggcacacgcctgtaatcccagctactcggaaggcccaggcaggaggatcgcttgaacccgggaggtggaggctgcagcaaaccaagattacaccactgcactccagcctgggcaacagggcgagactccatctcagaaaaaaaaaaaaagaccagcctggccaacatggtgacaccccgtctctagtaaatatataaaaaaattagctgggcatggtggcacacggctgtaatcccagctactcgggagccccaggcagtaggatcgcttgaacctgggaggtggaggctgcagcgagccaagatagcaccactgaactccagcctgggcaacagggtgagactccatctcagaaaagagagaaaaaaattaaaaaaagaccagcttggccgacatggtgaaacctcatctctactaaaaatacaaaagtattagctggccgtggtggcacacgcctgtaatcccagctactcgggaggcccaggaaggaggattgcttgaacctgggagtttgaggctgcagcgagccaaaattgcaccactgcactccacccgagtgagactccatctgaaaaaaagaactccagccacggcaatatagcgagactcaacctcaaaaaaaaaaaaaaaaaaaaaaaaaacaccagcctggccaatatggtgaaccccgtgtctactaaatatacaaaaaaattagctgggtgtcacggcacacgcctgtaataccagctacttggtaggcacaggcaggaggatcgcttgaacccgggaggtagaggctgcagtgagccaagattgcaccactgcactccagcctgggcaacagggtgagactccatctcagaaaaaaaaaaaaaacaaaaagagcagcctggccaacatggtgaaaccccgtcaatactaaatatacaaagaaattagctgtgcatggtggcacacgaatgtaatcccacatactcgggatgcccaggaaggaggatcgcttaaacccgggaggtggaggctgcagcgagccaagattgcaccactgcactcgagccagggcaacagggccagactccatctcaaaaaaaaaaaaaaagaccagcctgggcaacatggtgaaaccccatctctactaaatatacaaaaaaattgctgggcgtattgctacacacctgtaatccccgctacttgggaggcccagacaagaggatcacttgatcccgggaggtggaggctgcagcgagccaagattgtaccacagcacttcagcctgggcaacagagcgacactccatctcagaaaaaaaaaaaaaaaaaaaaaagaacaggttggccaacatggtgaaaccccatctctactaaatatacaaaataattagctgggcgtggtgacacacacctgtaatcccaggcaggaggattgcttgaacctgggaggtggaggctgcagccagccaggattgcaccactgcactccaccctgggcaaaatgtgagactccatctgaaaaaaaagaagcattccagcccgggcaatatagcgagactccaactcgaaaaaaaaaaagaccagctggccgacatggtgaaaccccatctctactaaatatacaaaaatattagctgggcgtggtggcacatgcctgtaatcccagctactcgggaggcccaggaaggaggatcgcttgaacccgggaggtagaggctgcagcggagccaagattgcaccactgcgctccatcctgggcaacagagtgagactctatatgaaaaaaaagcactccagcctgggcaatagagcgagactccatctcagaaaaaaaaaaaaaaagaaagaccagccttgccaacatggtgaaaccccgtctctactaaatatacaaaaaaattagctgggcgtcatggcacacgcctgtaatcccagctactcggtaggcccaggctggaggaatgcttgaacccgggaggtggaggttgcagcaaaccaagattgcacctctgaacgcctgcctgagcaacagggtgagattcaatctcagaaaaaaaaaaaaaaaaaaaaaaaagagcagcctggccaacatggtgaaaacccatcaatactaaatatacaaagaaattagctgagcatggtggcacacgaatataatcccagctactcgggaggcccaggtaggaggatcccttgaacccgggaggtggaggctgcagcgagccaagattgcaccactgcactccagcctgggcaacagggcgagactccatctcaaaacaacaacaacaacaacaacaacaacaacaaaaaacagcctgcccaacatggtgaaaccccgtctctactaaatatacaaagaaattagctgggcgtcatggcacacgaatgtaatcccagctactcgggagtcccagacaggaggatcgcttgaacctgggagttggaggctacagcgagccaagattgcaccactgcactctgctctgggtaacagagtaagagtccatctgaaaaaaaagaagcactccagcctgggcaacagagagagactccatctcagaaaaaaaaaaaaaaaaaaaaaaaaaaaaaagaccaggttggccaacatggtgaaatcccgtctctactaaatatacaaaaaaaattagctggacgtggtggcacaggcttctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctcagaaaaaaaaaaaaaaaaaaaaaagaccaggttggccgacatggtgaaaccccgtctctactaaatacacaaaaaaattagctgggcgtggtggcacatgcctgtaatcccagctactcgagaggcccaggcaggaggatcgcttgaacctgggaggtggaggctgcagcgagccaagactgcaccactgcactccggcctgtgcaacaaagtgagactccatctgaaaaaaaaagaaacactccagcctgggcaatatagcaagactccatctcaaaaaaaaaaaaaaaaaggaaaaaagagcagcctgtccgacatggtgaaaccacgtctctactaaatatgcaaaaaaattagctgggcgtggtggcacacgcctgtaatcccagctactcgggaggcccaggcaggaggatcgcttgaacccgggaggtggaggttgcagcgaaccaagattgcaccactgcactccagcctgggcaagaaagtgagattccatctgaaaaaaaagcactccagcctgggcaatatagcaagactccatctcaaaaaaaaaaaaaaaaaaagaccagcctgtccaacatggtgaaaccccatcagtactaaatatacaaagaaattagctgagcgtggtggcacacgattgtaatcccagctactcgggaggcccaggcaggaggatcgcttgaactcgggaggtagaggctgcagccagccaagattgcaccactgcactgaaccctggacaacagagtgacactccatctgaaaaaaaagaagaactccaaccagggcaatggagcgagactccatctcagaaaaaagaaaaaaaaagagcaccttggccaacatggtgaaaccccgtcagtactaaatacacaaagaaattagctgagcatggtagcacacgaatgtaatcccagctactcgggaggcccaggcaggaggatcgcttgaacccgggaggtggaggttgcagcgaacaaagattgcaccactgcactccagcctgggcaacagagcgagactcccactcagaaaaaaaaacaaaatgaaaaaaaacaccagcctggccaacatggtgaaacaacgtctccactaaatatacaaaaaaaatagatgggcgtggtggcactcatctctaatcccagctactcgggaggccaacgcaggaggatcacttgaacacaggaggtggaggctgcagctagccaagtttgcaccattgcactccagcctggcaaaccaagccagccaagccaaccagccaagccagtcaagcgacccagccagccagccagccagctaagccacccaaccagccagcctgccaagccagccaagccagccagccagccagccggccaggcagccaagccaagccagccaagccagctagccagccaagtcagccaagccagctagccagccaagtcagccagccaaaccagccaagccacccagccagccaagccacccaagacacccagccagccagccagccaagccagccaagccacccagccagccaagccagccaagcaagccagccaagccagccaagccagccaagccaggagccagccaagccagccaagccagccaagcctgccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagcaagccaagccagccagccagtcaagccagccaagccagccagccaaccaggccagctaaaccagccagcctgccaagccagccaagccagccagccagccaggccagccagccaaacaaggcaccgcagccagcccagccagccacacaagccagccaagtcagccagccagccaagccagccaagccagcccgccaaggcagccatgccagccagccagccaagccagccaagccagccaagccagccagccacccagccagccaagccaggcagccacccagcaagccaggccagcctgccacccagccagccaagccagacaagccagccaagccagccagccacgcagccagccaggacatccagccacccagccagccaagccatgcaagccaacaagccagcccagacagccaagccagccaagcaagccagcaagccagccagccaagccagccagccaaaccagccaagccacccagccagccaagccacccaagacagccagccagccagccagccaagccagccaactagccaagccagccaagcaagccaccagccaagccagccaagcctgccagccagcagagccagccaaccagccaagccagccagccagccacttaagccatccaagcaacccagccagccaagccagccaagccaccgacccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagcctgccaagccagctagccagcccagacagccaagccagccagccagccaagccagccaagccagccagccagccaatctagccaagccagccaagccagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccgccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagctggccacccagccaagccagacaagccagccaaccagccagacagcccagccagacagccagcccaggcagccaagagacccaagccagccagcgaagctggccaacccagccaagccagtcagccaaaccagccaagccggccacccagccaagccagccaagccagcgaaccagccagacagccctgccagacagccagcccaggcagccaaaccagacaagccagccagccaagccagccaagccagccagccagccaagacaggccagccaagcaagccatggaagccagacagccagccagccaagctagccaacccagccagccaagctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaacccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagccccaagccagccagcaaagctggccaaaccagccaagccagtcagccaagccagccaagccggccacccatccaagccagacaagccagcaaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccggccaagccactcagccagccaagatggccaagccacccagccagccaagcctgccaagagacccagcaacccaagccagccaagacacccagccagccaagctagccaagacacccagccagcgaagccagccagccagccagccagccaagccagccaagccacccagccagccaagccaggcaaacaacccagccagccaagccagtcaagccacccagccagccaagccggccaagccacccagccagccaagctggccaagtcactcagccagccaagccagccagccagccaagccggccaagccactcagccagccaagatggccaagccacccagtcaagccaactaagccagccaagccacccagccagccaagctggccaagccactcagccagccaagccagccagccagccaagccggccaagccactcagccagccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgaagccagccagccagccagccagccaagcctgccaagccacccagccagccaagccaggcaaacaacccagccagccaagccagtcaagccacccagccagccaagccagccaagccagccaagccacccagccagccaagctggcaagccactcagccagccaagccagccagccagccaagccggccaagccactcagccagccaagatggccaagccacccagtcaagccagctaagccagccaagccacccagccagccaagccagccaagccactcagccagccaagccagccagccagccaagccggccaagccactcagccaaccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgagaggcagctaggcagctagccaagcctgcccagccagctcgagccagctaagccaggccaagcaagctagccatccaagcttgacaagccagccaagcatgccagccaagccagcgcagctggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagccagccaagccagccagccagtcaagccagccaagccagccagccaaccaggccagctaaaccagccagccagccaggccagccagccaacccagccaccgcagccagcccagccagccacacaagccagccaagtcagccagccagccaagccagccaagtcagccaagccagccagccagccaagccagccaagccagccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagccagccaagccggccaagccagccagccagccaagccagccaagccagccagccagccaagccagccaagcaagccagcaagccagccagccaagccagccagccaaaccagccaagccagccagccagccaagcgctttacccgaacgtccgtgaggcagtgagagccaaagcagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaacccgccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaacagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagccaacccagccagccaagccagccaagccagccaagccagtcagccagaaaagccagccaagcctgccagccagtcaagccagccaagcctgccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccggccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagcctgccagccaagccggccaagccagccagccagccaagccagccaagccagccagccagccaagccagccaagcaagccagcaagccagccagccaagccagccagccaaaccagccaagccagccagccagccaagccacccaagacacccagccagccagccagccaagccagccaagccacccagccagccaagccagccaagcaagccaggcaagccagccaagccagccagccagccagccacccagccacccagccagccaagccagccagccacccagccggccaggccagcctgccacccagccagccaagccagacaagccagccaagccagccagccagccagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagacaggcatgccagccaagccagccaggcagccaagtcagccaagccaggcagcaagcaaagccaggcatgccagcccagccagccaggcagccaagccagcaaaaccagccagccagccaagccaggcatgccagccaagccatccagccagctaagccagccggctagccaagccagacaagccacccggccatccaagccagccagccaagccggccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccaagccagccagccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccagccaagccagccaagccacccagccagccaagccagccaagcaagccagccaagccagcgcagccaggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacccaagccagccaactcagccagccagccaagccagccaagccagtcagccagccaagccagccaagccagccaagccagtcaagccagtcagccagccaagccagccaagccagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagccagccaagcctgccaagccaaccatccagccaagcctgcaaagccagcccgccagcaaagccagccaagtcagcctgccaagccagccaagacagccagcaagccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccaactcagccagccagccaagccagccaagccagccagccagtcaagccagccaagccagccagctaaccaagccagctaaaccagccaagcctgccaagccagccaagccagccaagccagccagccagccagccatcccagccagcccagccagccaagccagccagccacccagccggccaggccagcctgccacccagccagccaagccagacaagccagccaagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagccaggcatgccagccaagccagccaggcagccaagccagcaaaaccagccagccagccaagccaggcatgccagccaagccatccagccagctaagccagccggctagccaagccagacaagccacccggccatccaagccagccagccaagccagccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccacccagccagccagcccagccagccaagccagccagccagcccagccagccccgccagccagccaacccagccaccgcagccagcccagccagccacacaagccagccaagtcagccagccagccaagtcagccaagccagcccaccaaggcagccatgccagccagccagccaagccagccaagccagtcagccagccaagccagccaagccagccagccagccaagccagccaagccagccaagtcaactgagccagccaagccagtcagccaagccaggcaagccagcaaagtcagccagccagccaagccagccaagccagcccagccagcccagccagctaagccagcccagccagccagccaagccatccaagccagccagccagccagccagcccagccagccaagccagcccagccagccaaccaagccagccagccagccatgccagccaagccagccagccatccaagccaaccaagccagccagccaagccagccaagccagccaagccagccaagccacccaggcagccaagccagccaagccagccaagccagccaggcagccaagccagccaagccagccaagccagccagccaagccagccagccagccaagagagccaagccagccatccagccaggccatccagccacccagccagccaagccagcctgccacccaaccagccaggccatccagccacccagccagccaagccagcctgccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagcaagccagccaagccagccaagccaggagccagcccagccagccaagccagccagccacccagccacccaagacagctaaaccagccagcctgccaagccagccaagccagccagccagccaggccagccaagccagccaagccattcaagccagccagccagcccagccagccaagccagccagccagcccagccagcccagccagccagccaacccagccaccgcagccagcccagccagccacacaagccagccaagtcagccagccagccaagccagccaagccagcccgccaaggcagccatgccagccagccagccaaaccagccaagccacccagccagccaagccacccaagacagacagccagccagccaagccagccaactagccaagccagccaagcaagccaccagccaagccagccaagcctgccagccagcagagccagccaaccagccaagccagccagccagccaaaccagccaagccagccagccagccacttaagccatccaagcaacccagccagccaagccagccaagccaccgacccagccaagtcagccaagccacccagccagccaagccagccaagccagccaaaccagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccaaccaagccagccagccagccaagccagccggccagccaagctagccaattcactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagtcagccaagccagccagccagacaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccagccaagccacccagccagccagccggccaagccactcagccagccaagccagccagccaggccagccgggcaagccattcagccaggcaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccagccagccaagccagccaagccagccagccagccaagccaggcatgccagccaagccatccagccagctaagccagccggctagccaagccagacaagccacccggccagccaagccagccagccaaggcagccaagccagccaaccagtcaagccagtcagctagccaagccagccaaccagccagccagtcaagccggccagcctgccagccaaccaagctggacagacagccaaggcagccaagccggccaggcagccaagccagccaagccactgacccagccaagccacccagccagccaagacagccaagccagccaaaccagcctgccagccaagccagccaagccatccagcctgccaagccagctggccagccaagctagccaatccactcacccactcaagccagtcaagtcacctggccagccaagccagccaagccagccagccagcccagagagccaagccagccagcccagacagccaagccagccagccagccaagcctgccaagccacccagccagccaagccaggcaaacaacccagccagccaagccagtcaagccaaccagccagccaagccagccaagccacccagccagccaagctggccaagccactcagccagccaagccagccagccagccaagccggccaagccactcagccagccaagatggccaagccacccagtcaagccagctaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccagctcagacagccaagccagccagccaagccagccaagccagccagccagccaagccggccaagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagcaagcaaagacacccagccagccaggttagcaaagacacccagcagggagccagccagcaagccagcgagccaagctgggcaaggccaccaagcgagcccggcagctcagtcagtcacagaggccagcagaccgtggtcaagccacccagccagctaagcagatctacgcacaagctctccaagccactcagccagctaagctagccagcagtcaagccggccaagccactcagccagccacggcgccaagccacgcagtcaagccagccaagctagccaggcagccaaggcagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccacccagccagccaagccaggcaaacaacccagccagccaagccagccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccaaccagcaagcaaagccaggcatgccagccaagccagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccagccagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccaagccagccagccagcccagacagccaagccagccagcccagacagccaagccagccagccagccaagccagccaagccacccagccagccaagccagccagccaaaccagccaagccacccagccagccaagccacccaagacagccagccagccagccaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccggccggccagccaagctagccaatccactcacccactcaagccagccaagtcacccggccagccaagccagccaagccagccagccagcccagacagccaagccagccagcctagacagccaagccagccagccagcaaagccagccaagccagccagccagccaagccagccaagccacccagccagccaagccagccagccaaaccagccaagccacccagccagccaagccacccaagacagccagccagtcagacaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagccagccaagccagctagccagcccagacagccaagccagccaggcagccaagccagccaagccagccagccagccaagctagccaagccagccaagacagccaagccagccagccagccaaaccagccagccagccaagccagccagccacccagccaagccagccacccagcaaagccagccaagagacacaagccagccagcaaagctggccaaaccagccaagccagtcagccaagccagccaagccggccacccagccaagccagccaagcctgccaaccagccagacagcccagccagacagccagcccaggcagccaagagacccaagccagccagcgaagctggccaacccagccaagccagtcagccaagccagccaagccggccacccagccaagccagcaaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagtcagccagaaaagccagccaagcctgccagccagtcaagccagccaagccagccagccagccaagcggccaagccgcccagccagccaagatgccaagccacccagccagccaagcctgccaagagacccagcaacccaagccagccaagacacccagccagccaagctagccaagacacccagccagcgaagccagccaagacagccagccagccaagccgccaagccagccagccaagcaagccatggaagccagacagccagccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccaagccagccagccagccaagcggggggagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccgcccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccagccaagccagccagccagccaagccaggcatgccagccaagccatccagccagctaagccagccggctagccaagccagacaagccacccggccagctaagccagccagccaaggaagccaagccagccaaccagtcaagccagtcagctagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccagccagacagccaaggcagccaagccagccaggcagccaagccagccaagccactgacccagccaagccacccagccagccaagagagccaagccagccaagccagccaaaccagcctgccagccaagccagccaagccatccagcctgccaagccagctggccagccaagctagccaatccgctcacccactcaagccagccaagtcacccggccagccaagccagccaagccagccagccagctcagacagccaagccagccagccaagccagccaagccagccagccagccaagccagccaagccacccagccagccaagccagccagcaagccagccagacagccaagccagccagccacccagccagccagtccagccagccacccagccagccaagccagccagccatccagccagccaggccagcctgccacccagccagccaaggcagacaagccagccaagccagccagccacccagccagccaggccagccagccactcagccagcccagacagccaagtcagccaagtcagccagccagccaaggcagccaagccagccaaccgaacaagagagccagccaaccaagccagccaagccagccagctagccaagccacccagccagccagccagccaaaccagccaagccacccagccagccaagccagccaagccaatcagccagccaggcagccagccacccaagccagccaagccagccaagccatccaagccagccagccagccagccagccaagccagccaagcctcccagccagccaagccagccaagccacccagccagccaagccagccaagccacctagccagccaggcccgccagccagccagccagccaaaccagccaagccacccagccagccaagccagccaagccaatcagccagccaggcagccagccacccaagccagccaagccaaccaagccatccaagccagccagccagccagccagccaagccagccaagcctcccagccagccaagccagccaagccacccagccagccaagccagccaagccacccggccatccaagccagccaagccagtcagccagcccagacagccaagccagccaagccagccaagcccgccaaccagccaagacaggcatgctagccaagccagccaggcagccaagccagccaggcagcgaagccagccaagccagccaggcagcgaagccagccaagccagccagcaagcaaagccaggcatgccagccaagccagccagctagccaagccacccagccagccagccagccaaaccagccaagccacccagccagccaagccacccagccagccaagccagccaagccaatcagccagccaggcagccagccacccagccagccaagccagccaagccacctagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagccagccggctagccaagccagccaagccacccggccggcaaagccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccatccatccaagccagccaagccagccaggcagccaagccagccaagccagccagccagccaagccagcgaagacaccgagccagccaaacaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccggccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccgctcacccactcaagccagccaagtcacccggccagccaagccagccaagccagccagccagcccagacagccaagccagccagcccagacagccaagccagccagccagccaagccagccaagccagccagccagccaagccagccaagccacccagccagcccagacagccagcaagccagccagacagccaagccagccagccacccagccagccaggacagccagccacccagccagccatccagccagccaagccagccagccatccagccagccaggccagcctgccacccagccagccaagccagccaagccagccaagccagccagccacccagccaagccagccacccagcaaagccagccaagagacccaagctttttcagccaccagccatcactatcctcttgttttcaaacaggattgggatttgattatttcaaacccttcatgggattgaaactttgtcttaagtcagtgactactacatttccaagtactttcgaggagacatattttcatgtgtttttttgcatagctctggatttcaacttacacacccagaaatgtcacctttagaggcccctttgttgagtacatttgatctcaagtattccaggtctggggatggatctagctggaaaatgttcagacactgaagtttctagagcctgaagatgctcccctatcaggtaccaggaccagccagatctcattctctgactctacataacttctgacaaatgaaatgaagtttccgtttttggccaaccatggagcctgctccgtgtctgatattcttctttgaagactgaggatgtgacctgattgttctctgcctcctttttctagctacatttttttttttagctggttctcacacgggctttccatggcctctctctgattgtggggactggccgtttcccaggcacagcaccttggcctgggggagccgtgagaactgatgagtgtcttttgaaggagtcactgggcttctgcaatgggaggatcttggtgtgtggggagcgtgggaacttttccttttgttggttcaggaatgaaattgttgtgtaaatggaccaagagacctaaggaaagggacagtccttttggctggtgggtcctctccactgatagatccaaacaacagagtggaaaatgtaccacaagaagactacgctcgttgcctggaactcagtagcccctgtggctggtgttggcacttgccttaccagtgtgagcctggttttcccgatcatttggccttccacaataaggacaatttaagagattatttctcaatgttaactacttccttgattaattttgtgatctacctttctcctttctgaccagtagtagaatccatttatgttttcaagatgttgctacttaggatacaattatttctaagaaatacaagtgacattgctttgtagaatgggaaccatgttctacagccctgcaaagacctgtcctgagagagctggggggacgcaggcttggaggaggtgagggcaggcactgagtgggtggagggaatcaaacggctgccagaataaacatcagatggagctcctgggcttcttgaggggtagaatttcctctgagctctctacaagacctcagccacaaccattcatctacttaatacattgaagcaattcacataaaaagccagacagatttttttctctgaatttaaaactggatttagagactagattaataaatattgtctttgtcatgtgagtcactttggagagaatcatgtccccactgtatggcaatgcagcagatcctgaccatgcatatttagtgtgtccttcctgctctcttgggcagaccatcccatcaggctatagcacggagctctcacccatctccctgctctgccatgcaccctccttcttgcctgctctttcttctccctatggccagcccctccagccaacatactttttatctctctttgttttgcaaaatccttttctcctatcacttccatcataaaactagtatttggcaaacaatcacatgtcggcataaagctcttaaattgacctgctttagattaaagcacaatatgggttttatagtttgcctcaggtgaccatttaaatgtcttgaataatgaaatgaaaaactggacagactaaaataagagtcctgtctgcctgtgacagtgaagaataagagtcctgtctgcctgtgacagttaaagaatgatccctcattgcctctcacacagctgcagtcagggttcccaccaccctttctgctgattctgaaatcagccctagttcataaattatcagggaatttggtgagttttctcttttaatgtcagtctgtttatttgactggtagtttctggccttaacacatcccactaatgtgttgtttagttgagcacaataataaatagaacttttgtttacttttacatccaaagataaatgttgagtgctattaaaaacttttctaacatagtaggcctccaatgaggaattttccttcagcaaatcataaaactgggtctagaagtgccaacccaagtaaaattactgatgaactaatcatagttgttatttttccttcatcttttcctttttttttttagacaatcttgccctgtcgcccaggctggagtgcagtggcgtgatctcggcttgctgcaagctctgcctcctgggttcacgccattctcctgcctcagcctcccgagtagctgggactacaggcgcccgccaccatgcctggctaattttttttgtatttttaatagagacggggtttcactgtgttagccaggatggtctcaatctcctgacctcgtgatccgcccaccttggcttcctaaaatgctgggattacaggtgtgagccactgcgcccggctccttcatcttttctatgtgctttgtttgacacttattgaggatacagttgctgaagaccagctgagtaggacataggctctgtcatgcattaactcatccacccattcatttattcactcatctattgagcatctgctatgtgtcaggctctatgccaaactttctgttcaggagccaatatatcaataactacagtgtaagctaagtcatgcaatgaaagacttagagaatagacaccaagttgaatattaacccaagtaaattattggaagatatattagttatctaaaataggcttaaaacaataaacatttattatcacaatttctgtaggtccagaatctggacatgacttagcttgatgtttatggctcaagacctcttgaggtttcaataaaggtgttagtcagggctgcagtctcatctgaaggctcatctggttgggggtggtgtctgtatctatgtggttattggcaggccttggtcctcactacactggaactcttcaaagggttatctcatgacacagaagctagctttccccagggtgaagaatgtaaaagaatgtgagaactcttaagacagatgctatagtcttttctataacttaattttggaagtgatattccatcacttctgccatattctttgttagaatcaagtcagtaaatccagcccagattcaagtgaaaggattccacaagagtgtgagtaccaagaggtagggatattgggagccatctgagaggctgcttaccacagagggccagccagttaggaagtgggttcagctgctgctgttaacaggctcgacctaagtggcttaaacacagaagagttgttgttgttgttgttttttctaatgagaaatctggaggcagtcagttgctggccttggctcaaaggctgagggcactgtggttcttgtagcctttcgcttatggccctaagctgctggaactcttgccatcatgtctgcattccaagcagcagaacaacaagaaaagaacagggggagaagagaaagagggcaccagcccactgactatcctgttcatcctgggaagtaccactcaacaagctcaactctcatttccacagccatctccagctgctcaggagtctgggaaatgtaatcacatgcaccattatccccaagtgcaccactgcctccagcccctttccacctttcagttatagccataaacatccagttagccataaacattcagctaatgcatgtgcagattcttgatctacagaaattgtgatagtaaatatttattgttttaagtctatcttagatcactaacatatcctctacttaacatttcacttgggttaatattcagcttagtgtctattctcaagttttccattgtatgtcttcgttcgcactctcctcattgaaatattggctcctgattagaatgcttgagtactgttcttttataccaccaagcctgctcctcaagccgattttgtgccccgcaagccagcgatggctctattaatggttgtccttgtcttttatgagttcatgtgactgggtgggggagattcaacacccaccctcatgctgctcactctcaagtaaacaagtaagccaacattagagtctcagggctatgaatgggagcacagaaatcacagtgcaacctcccaagtacaggtcaggaagcctggtttaaatatttgaaagcaatttgaggaagttcccagtgggaaatgaacttgagaactaggtcattcatatgtccattcaacatctaccttctgcttatctggagtgtgcatggcactgcctggggccactgcagtgaataagagagatgagaacccaggcaactccgagagacccagtcccacctgctttgctggcaggggcttaggatgcagtcactttccattaaagtcagagtcctggagtcccatctgctttgcttctgcattccctacaatgatgagtggttaggagtccaggtctcagagaaagactgtctaggtgtgggtccccaccttgtcacttctgtgtccccttgtgtgagctgctggacatctctgggcctcagtttcctaatttataatgtggttgcctgtcagaggattacatgagaagatgcatattgcttagcgtagtgccaagggcatagtaatagcccaacacttattaaccacgttgatgatggctatggagatgatggtgatgatgacaatgatgttgatgatgacaatggtgatgattatgattcagtttctattctaagatgtggttacagtttcctaactttgggagatatgcctatctgtatatatcacggcatagtctctttctcttattgtagagaaaacaccttcacattatagatgcaccgcttggccttcctatctctcagtgtagaggagactctggaattcctcttgactggtccagatgcccacaaaattctacagacaagcagcaccaaacttaagagcatacatgtgatccaaaatattcttttaaagtcaaagctgtcattgcatttttccagaaataaaatgataaaaactgtgcacaggactgcttatcatacttaactcttaacacagctgacctttaaatggcattaagagtaccaacctgagttctgggtcctaggaaccaggaggagataaaagattaagaaatagggaaggagagcccgggtgtggtggctcacgcctgtaatcccagcactttgggaggctgaggcgggtgcatcacctgaggtcaggagttcgagactagctggccaacatggtgaaaccctgtctctactaaaaatacaaaaattagctgttctgcagacttgggtctagaggtgatcagtttttccccagccaaagcccaagggcagccttgctcctctctccctcccctggcttatgttcccctgtgtatgactgtgtccctccagcccatgacctatagagaatgcagaccatctctctgccagtgttggagaccagatcccatggaagggcactcatgtccagcctggggccccctgccttggcagacactactagttgacataatccagctacttgggaggctgggacaggagaattgcttgaacccaggagtcagaggttgcagtgagctgagattgcactgctgcactccagcctgagtgacagagtgagactctgtctcaaaaaaaaaaagaaaaaaaaaaaaagagaaagaaacagggaaggaaaaatgactggaagaagatgaatatgctgagccacattctgagattgagaagtctatctatgatcacttgcacctcttctcttctgggtagtgtctacttccccacgtccctctgccattcttttgctgaagccatgcccaccttaccatggggtgcagggcagtgaagaagcagcaagctgcgaaggctgagccatacctggaaagagtgactgctaagtgcgtgtgtccctggaggcatttgttccttcacaaggaaatggttgtgaactcaaactgggttctaattgtcaacattcaagggagttggcaaaaagagtcattattcaataaactataccaaatactacagtatgtgcctggcatgttgtagatgctggagacacaggagtgaacaaataagcaaagcccctgccctgtcactgcatttctgcagaaaagatgttttgcttcagggaagccaaatcgctcaccaggagcctggccccgagtccactcttggggtcaacacccagggctgcccagtgggctgtgtctgctgtccccccggtcctagcccacaggctttttgaaatctccagtgtgctcgccatgaggaaagcaggggtgaagtctgctgggcagcctttgtcatgtctgtgattaaggacgactcttttctggaaattaaaatgagcagtcctgctatctcaccgtacaatcactggcatagtttacttttttattctgtgtctggattttccccctggggctgcagcagtaagcctgcttccttggttcaaagccagtgtgtgtttctgcaagaaagaacttctggatcagcagggccccttaacaggctgcaagctggctcttgagagggagcaggcagccaaacaatatttggcctgtccttcccctccatgccagccttagttctggttcctgctcagtaggcaaggggcagcccaggacttcagagggaacctgataacttgtctttgtgtgattaaggctgggtagcagagcccactgagaaccagctatgcttcaccataaaaatagaacttagctctgggtaccagggagttttaataatgtggaaaaatgcttatgttgtcatgttaagtgaaataaagtagagtcctaagcaatgtatacagtgtaactacaactctgtaaacagagagagagcagaaggaaatataggaaaatattaatagtgtgtggctttggaaggtgggattaatatgctctacttggctgggcacagtggctcatgcctgtaatcccagcactttgggaggctgaggtgggtggatcaagaggtcaggagttcgagaccagcctggccaacatggtgaaaccccgtctctactaaaaatacaaaaataagccaggtgtggtggcatgcacctgtagtcccagctacttgggaggctgaagcagaagaatcacttgaacccgggaggcagagattgcagtgagccaagatcatgccattgcactccagcctgggtgacagatgagactgtctcaaaaaaaaaaaaaaaaaaatacgctctactcttctaattttctaggttatccccaggcagcatttataacttttataatcatacaaaaataaactttatattaaaatatacatattttgcatattttaatacttttccccagctttaagaatatctgataaaagaaatttatgttactctaacgagcagctgctatcttggttaattcatattttttcacaattaataatataaacattaaacagaaactggtgggagcaattgtccattgggtaatcagtgggcgaaactgcccatgaaatgaaagcaaaacaaaaaacaatatgaaaataaaaacaaaaaatccacaaactacatcagaaatgaatttcctctttgggacatgctgaaaaatatcctgggtaaaatcaaggtattttgcaattatttttcaagtaaatattgtacagagggacgcagtgatcaatgctgctttcctttactgctttgcaggcctgtctagaaactttagtggccagagaggcggcctgcaggctcagggataactgtcttgccaacaaggaacttgttaagttccttgttgcagtttcctactatgaaaatgtggggtagttttgtgggaaactgttagttccctagtcaatttctgaaagatctaagagaataaggaagttcaccaaatcgcaaattacggtggggttacagccacactgcagatttttacaatgtggtacccagagttgattaggatggggcccactgtatcaattacacttaacggttcgttgcatatagcagaaacctacaataacaaaggctcgaatacaagacattttattgtttcacataaaagaaatccagaggataatgggtctggggttacctggccactgctcatccctgctaactcaggctccttcgacctcttcaccctgcctctccccagtggtggccacccccagctgcaagggcgataacacacgtggagttgttctaggaagaattattttgtgcccagctgaaaatcaggggcttgattatcagggaagggggagaacacatgtggggttaggcaatcagcagtcactgccgtggccatgactggagcatgtcgaatgttctgaggcctccagggggtgcatggcagtctctcagtagtgtgcaacttggcctttctcgacccagaagcctataaacagataataaagcaataaattagctgccacacacagctcggtaccctacagtagaacaggggcaggataatagcaacagcaccaccattccaagaggagcagacaggaggcacacaggggcccctgcctagcaataaaccttctgagcatgcagtgggaggcctttccccctggttttctggtttatccctggggaacctctctactcactgtcctctggggcccctagcttgtgctcagagagaccctctggtctctcactctggatagctgtgtatgatatgggattagggacatgcccttagtggggtctgcacagctcctccttcccacttgctgctgctgaaggttggaggttccacagttgaatagtcgaatgcctttaaaaaaattgagatgtcgtggggcacagtggttcacgcctgtagtcctagcactttgggaggctgaggccggaggatcccttgagcccaggagtttgagaccagcctggaccatgcagtgagacctcagctctacaaaaaaataaaacaattagctggatgtggtggtacgtgcctgtagtcccagctactcaggaggctgaggtgggaggattgctttagcccaggaggtcgaggctgcggtgagtcatgaactcaccactgcactccagcctgggtaacagaaccaaacactgtctccgaaagaaaaaaagaaaaaaaagggagggcggtgaaattcaggtaacataaaattaccatttaaaaatgaacaaattcagtggcatttaggacaaccacaacatcgtacaaccaccacttctgtctggttccagaacattttcctcaccccaaaaggaaaccttgtactcattaagcaattattctcattcccacctccccccccagcccctgacaaccgctaaactactttctatctgaatggacttgcctattctgaatatttcatatcaatggaatcatgtagtgtgtgtccactttgcataatgtattcaaggcttgtccatgttgaagcatgtattaatatttcattctttttatggctgaataatattccaatttatccataaaatatatttttaactcatggtttctttgacaattcaggatccacaaaaacacagtcagcttctgacctagttgcttctcatcagctccctggctgcagtcacactgaattcttgccaagacctatgcctcagacctgctttattgcttttcttttgtgccccttccctcactctcatttgatggaatggtggctaccttgactcttcccggaacaccatatggcaaacgccagtcctttcccttcatctcattctgagccgcttcagaccttgaccactcaaaggccagcacagtctcatctctaatatttgggctttataagcagtcgacttttctgactttgcaaagccctgaatttctgaactctattcctttcctaagaacaacaattccgttgacttctaaacagcattggttgcatcaccaaggggaaaaaaataaaccaaaaaaacccaaaaaacccaaaaaccccaaacctctgccagttaaaccatgtcatgccgtataaagcaagtgccattacaatgtgaaaaagaaatatgcaccgcagagttgacgacgtgcagtaaaacagtaccgatatgaatggctgacattagttgaggttctacgctgtgtcaggcattgtgaatcttttgagagagatgtcagaattgttatctttcttttacagaggaggcagtggaggcagagtgaggttcacacccagcaaccctcactcagaaggcttctgcttgggtagagcttgcattggccaaacctcatccacttgccattcattcagtcattcagtgacaagtgtttatggtcacctgtgggagtgtgtgtgtgggaagggtggaaaatttccctcttggtgttttcaatttagtggaggagtaaagccttgcagcaaaatatgaaagatcattcaaacattagggactcaagtgaacgcaaaggagttggggaaagttccgcttaggaagtgacatttgaatctggtcttcaagacgaagaaggaatttgcttggagagaggggctggaggagaaatgagcaggctgggggtggggggagcacaggtgtaggcagggagaaaagaaaaggggcttttggtttgagaccctgcgaggaggcagcatggaggaaggggctgcagggagctttggggttggggagaggatgcagctggaggagtccctgatgtcacttgggtattattaatgtcaataatcagcttatatagaatgaccttctcactagaataaacagtcataactgtggtgctttaatcaacatgacagcattggagaatctactcaaactcacttgggtctagaggggatcagtttttccccagccaaagcccaagggcagccttgctcctctctccctcccctggctcatgttcctctgtgtacaactgtgtccctccagcccatgacctatagagaatgcagaccacccctctgccagtgttggagaccagatcccatggaagggcactcatgtccagcctggggccccctgccttggcagacactactacttgacaacagatacccctctccccttcttgcttaatttaaaaaaattctatttcagatggcattgtgtcagttgaaagatcacattttctagactagtctgcagctaggtgagcccaggtgatctagttccatatgtggaaccattatgtggaattttcagtaggctccgtcacggtgggaagagatggcgttacacatttttctgtcgtccctcacttcctcctactgtcaatatggggaatacggacttgctggctggagtgccagcaggcatcctgggctgtgaagccactttgaagatgaaagccaggctctgggatggtggatcaggaagacaggggcccaatttcctagcaatgctttggggctgcacccttggcctgtgcttcctatgccaggctacttttacatgaaagagaaaaagaagtcctgacttaatgcattgctgtatttttccagaaatgtgcagccagacctaatgataggtggtttagggtgggaagcagagtaagatgacagaactttaggaccacatgaagggaaggagagggtcccccaggaaagggtgcagtttgttagacagaacaatagcatatccgttacaaagagctgccatttgctgggcgctaagggcctggccctctgtgaacctcaccatctgcatcatctcacttcatcctcaccagggtgggggcatgaggactctctcatgaccagggctattctcaatttacaaatgaggaaacaaaggctcaggaagggctctttctcaaggccactgagttgggagctacgttccactctgggtctgtttgtttcagggacaaaccttgaagccacacaagggccccgagaaactgtgcagatgtgaaacccagagtggcccgatcagatctatgactttgtgtcatcacaaaagtgaaagaagcagttcacagaaggagtggagtgtgcaggtcagaggcaggaaggacaggcagacactgtgatgatgataggctgtgaagaggtgggcgatgcctgggatgggagggactgtgttggacccagtgctgacctgagaacctcctctcaggccctcagtcaggctggcccctgttagacatgagatttgactcactggttcccattaacagccactagagatgaatgcactctatcaagtccatgtctgattaaattcaacaactcaggagtagtggtcaggaagtgtgctgattttttttcaatacaggtaaagtttttaattatgaacttttcagagggcaaactcagattgcttagggtgtatttgtccttgtagtgtttttgagggagtcattaggggcatggaataattaagtgaaaattaagaagctatgaaagaatcactcagctaagaaacaagatggtagatcaggctccgtctgatctcttggcagtatgcattagaccaaagggttatttaggtgtcaaggattttgttttgccagttatcaagcctaagaaacttcccagttacatcaaatcaagcaaaatgatgaaggctatcatccacccttgcttacaacaaaaagaaaccacttataagttcttcccgttagccaaaactgaagaatttaaactgccttggctcttaataatagttttactttatggttttcttgctagtatttcaaatacatagtctgtcttcaccaaactagaaatagttgataccaagaaaaacgtgtttgcccggactgaatgatgtcattgcacactcacggaccatgcactctttagcagcacccatctaattccatgctgacctgccttctccatttgtaggataactgcaatactcagaagccggctggtggatcccaggcctctatcattcaattgccatcactgtacttggtggggcctcaaaggatgctccagatcccattttcctgcttctctttttgaaagcattgtctatgggtgctgcacccactccctgcagccaagctcctgtgcctcactcatggaggctgccggggccatctccctggtcaccatggcctccatgtggccaggtcagtgcatcctgctctgctcctgtctgacttgacctctcagcagtgctggcaggtggacctctcctgccttcttgatacgctcactccttggcttctgagcggtgattttcttggtgttcttccaacctcaccctcactggctgagggtgctgggttcccttctcatctttctccacatattctctctctctctctcatccaggccaggtctttaattccatctgtagaacattaactcttgaatctgcctctaatattgacttttcccaagaattctaagcctactcaacatctccacatggatatctgataggcacgtccaaattaagatggccaaaaccaaatctgggatttcacaccacccatctctgtaagtggcactcctcagttactcaaaccaaaaatcgaaggattatgcttgattcatctctctccatcactgccctcgaacccaatccatccaacaactctatctccaaaacattactcaaacaggtcctcatctttctgtctctgttacactcatcagaccccaaggggacccactgatctcccttggttccacttggtcctacacaagggcttcacacttagcagtaagagttatcctcagaggctgggcatggtggcacatgcctgtaattcccgcactttgggaggctgaggcagctggatttcttgagctcagaagttcaagaccagactgggcaacatagtgaaactctgtctctataaaaactacaaaaattagccagcagtggtggtgtgcatctgtagttccagctatttgggagactgaggtgtgaggatcacttgagcccaggagattgaggctgcagtgagccatgatcacgtcactgaactccagcccgcaacagagcgagaccctgtccaaaaaaaaaaaaaaagaaaaaaaagaaaagaaaaaaagaaaaagttgtcctcagaaaattcaagtcagatcatgtcactctcctgtttaaaagcctccagtgtctcctcatcacacctggcacaaaattcaagctccttccttgccaccttctccagccccatcccatcttctcttgctgttgcttactaagcagcagccatcctggggactcttacttgttcctttgtgtcttggggtcttggcgacagctgctctcttgtcctggaatgctgctgactggctcctggacatcattcagatctcagcttaaatggcacctctccagagtgaccttcctagatgacctgcccatctcaagtatttccctcctaccctatgctaattttttgcactgttcaattcactagcttgtacttttctcatgtacttattttctgtctcaccctcctagaatataagcttcacgagaacagggatcttttgtgccttcttcttgctgtgtcccaggacctgagttggagcttggcatctggtgtgtattcattaaagattagttgaatggttgagtcccaaacttactgtcttttgctccatgtgttctgatatcttctttattatggtctgctttgttgagtaatgtgttatgatcatcgagatttactcataggcactgagtttcaaaagatgatgcatatttagtgtatgattcatttatttaaaattctagacttttgactgcagcctgtgactcaaatactgtattggtggaaaaactttcaaatcatcaaccacacgtatttgggttttaccagctccatggcacatacgaaaaatagccagtacttagagattgttcttattatcatcctagacatttgtggatattaatttttaattcttatataaccctatgagtatgaaactcttatccccattttgtaaattggctgaatgtgtcagttctctaatgctgtgtaacaaattcctgcaaatggagtgacattaaaacaaaccccatctatgagttcacagttctgtggggcagaagtctgggcagactccactgggttctctgctcagggtcacacaaaccaaaatcaagatgtcaaaggggttgggttcatgtctggaggctttaggggaaaattgacttgcaagctcatcggagttgttggtggaatccaattccttctggctataacctagaggtatctgttttactgctggctgtcagctgggggttgctcttagtgcttaaagacctcccgaattcctgacacgtgaccttctcctgctttgcgtctctgacttcctcttctgctttcagccagagaaaacgcgctgcaattttttttttttttttttgagacaaggtctcattctgtcacccatgctggagtgcaatggcatgatcacagctcactgcagcctctctgagtagctgggactacaggcatgcaccaccatgtctggctaaatttttaattttttttataggtaaggtctcaccatgttgctagctggtcttgagctcctagattcaagtgattcttccgcctcaggcttccaaagtgttgggatttctggtgtgagccaccacgcctggccaatgccttgcttttaaagggctcacctgactgggtcaggcctactcatctattctccttattttgtggtcagttaacttggactttattatacttacaaaatcctcttgcagtattacctattattagtgtttgactgaaaaagcagagacaggaatcttggggaagtatctttagaattctgcccactgccctgaggttcaaagaagttaggtgatttatccaaggtcatacaaccagcagtggaaaccagattcaaatcaaggcattctggcccccagagtctatgaccttgaataataccctgcagtgtgatgagaatccagtgctgcattggaaattctgctgggcagattttctgacaatctgatgtagccatgcaggtgagacgcactgggctactttgttcataaggaccggaactatccatggtgccttgtctcctcactcccatcacctccgatgtaaccgaagacagacatgaccaaagaagtcaggactctgcttttcaatggattgaacccacggatgctgcaccattttccacgagtcagcagcaccatttccaggtttttgctgcccccagaacttggttacccctcaaatcctttcatcatcagcatgagtgaaatcaatgtgactcccattaacaagaatattattattgtgcacatgagaattaagcccaaaatgcaatctgtgctcacacaggtttgatgatggatggatgcagtggtgtgctggcagtgacttgttctgggttttggaactaatttgttcatctctgcccaactcactttcagtgagagcatgctggtagtttgcaattggcaattggggagaatttacactagagaaatcagcaaacactacaaatcagggtttgctttattcatttatatttgaagatgtgattgctaaacatttgccagcacacctctggatggatggatggtagatggaagcggtgagagccaagagagcttggggattccagctttcataaccagaagcatggacattcttggaatgcttatgggggtgtggagggaggacccccagcatcagcccaggagaatgagtcttgtgagctgggagatgaagtctctaaataagtgagaagggaggtgatttgagctaggaatcttggcaaatagccccagggcagaggcagaggggaggagaaaaaagaaccatcagagccaggaagatcagtggaaaactggaggcctcacagaaagcaagggccttgcttgagcagaatgatgcctcttgagtttcttaaaaaggaaaaggtaggggtaaggggctgtttaatctattaatacttcagcccactctcagcacccaaataatagggtgggtgcatcaaatcttggtagccatatacataagaatacttgtaggggttgtttaatttagggccttataaagacaataaaatgacttattgagaatcactaaaccaacacccaagtatttaatgaaaatactttttagctcatatagcttgagacaccaaactatgactatgtaaatagctataccatgtttatagattggaagacttaatgtagtaaagaagtagattctacacaaattcattgataggtttactgcagttcctttcaaaatccaagggggggacattttgtagatacaaatgaactgatactagaatttatatagaaaaaaaccaagaatagccaaaataattttgaaaaaagaagaataaagttggaggaaacatactacctgattttaagatttaacatatagctgtattaatcaagattgtggtgttgggaaaggaatagactggtagattaatggaacagaattgaaagtccaaatataaatgcacataatatggccaagtgatttcttttttttttagacggagtcttactctgtcgcccaggttggagcgcaatggtacaatctcggctcactgaaacctccctcttccaagttcaagcaattctcctgccttggcctcccgagtagctgggactacaggcgtgcaccaccatgcctgtgtaattttttctgttttagtagagatggggtttcaccatgttgcccaggctggtctcaaactcctgacctcaggtgatctgcttgtcttggcctcccaaagtgctaggattacaggcgtaagccaccatgcccagccagccaagtgattttttttacaaagtcccaaaaacaattcaatggaggaaagatagactttttaacaaatggtgttttattggatatcctcagtcagaaaactcctcaatctaaacctcacatattgtgaaaaattaacttagaattgataatatgcctaaatataaaatgtaaaactctaaaacttttagaataaaacaggagaaaaatcttcattactagagttaggcaaatattccttagaagacctaaagcactatccataaaaaaaagataacatcaactggatttcatcaaaatacttttattctgcaaaatatattgttaaagaggatgaaaagaccagatatagactgggagaaaatatttgcaaattacatatttgatctaaaaagttgtacctagaatgtataaaggtggctctaaactcaacagtaagaaaacaaagaatccgattaaaaagtggagaaaagaatgagcacacggaaagatgctcagcatcattagtcattagggacatgcaaattaaagctatgaggagacaccatgactcacatgttagagcagctaaactaaaaatactgacaataccagcaggggaaaggatgaggatcaactggtctctcatgcatacattgctggcggaaatgcaaaatggattgtatggtcactttggagaaagtttgacagtttcttataagggtaagcatacagttaccatatcacccagcagtaaattaactatttactttagacaaaagaaaaacttacatccatacaaaaacatgtacacagatgtttacagcagttgtgtttgtcacagccaatgtggaaaacaaaacaaatttccctcaacaggtgaatggatgaacaacctatggtatatccataaaatggaatagttctcagacatcaaaataaataaaatcccacaacatcaccaaaggagactttagtttcatctgtaatgttttaaggttttaagtagacagactattttcatgttctatttgttgttgaatttttaaaattgatgtttcttttattacaaagtatgaaaactacaagagcatatctctgtgcctggtcaatgtcctgtcatgtagatagattctccctcaccatagccaaaccctctctttgagcagtaggttctagccttctttctaccccaccaaattccttctcattctctcttgcatcatcaatttttctctttctaccaaattatttctatcaacaagtacacggatgggctattatttttcccatcttaacaaataaggaaatctctcttgacctcatttccccctccagctatagctttatttctagaaagcagtgtctgttctgtcttcaatttctttcccctttctctcctcactcaattcagagtttcaccccctcttccccagcaaatccttttttttgccaaatccatgtatacttttctgtctccaccttacatgacctttcagcagtgattatgcaggtgatcagtctctcctccttgaagcaccttcttcacttgcccttgaaggtcctacactctccaggcttcccttccacctcaccagcccttacttcccccactcccatctttgctggctcctcctcactccctgacctcttaaagctgcagggcagggctcagttcttgctttctttttctacgttcatttctgtggtgaactcatgcaattccctaactttacagactacattagatccaatttaagatgtcctcaattataagatgcaccattaagttaaagttccactaaggaagaagaaagcactgccaattaaactcttttcaaactctttttttttttttttttgatatggctctgtcacccaggctggagtgcagtgacagtcttgggtcactgcaacctccacctctcaggttcaagcgattctcctgcctcagcctccccagtagctgggattacaggtactcaccaccatgcccggcaaatatttgtatttttaagtagagacagggtttcaccatgttggccaggctggtctcgatcacctgaccttgtgatccacccaccttggcctcccaaagtgctgagattacaggtgtgagccactgagcccagctgccaatcaaactcttacatcctatcatcccaatttcagatgtctctttgttctcagagtccctaaactgctctggagtgagtgatgatgcttctccttcccagcacccctcttggggaacagggttcgcacccttccttctatctctttccttctaactctcttcatcacccagcctgtggaatccttatatgagcttgggatggtatcgcctgtttctacacctagctttgccacatatggttgggcacatcacaacttgtatggatttactccattgggttgtgcagtatataacctgtacaactatacattgttgcctgacttcacccattcctccaaggttttttatttttctctttataatactgtcttagtctattttttgttgctgtaactgaacacctgaggctgactagtttataaagaagataaatttatttttagcaattctggagtctgggaagtccaaggttgaggggctgcaactggtgaggggcttcttactggtagggactctctgcagagtcctgagatggctcagggcaacacacggtgagaggacccaccagagacggccaaagtggctttcatatgagacccacttttgtgataacccattaatccattaatttatgaatgggtccattcatgagagcagagccctcatgacccaatcatctccgaaaggccccacctctcatattgctccattgggatccaagtttccaacacatcaacttctgaggaacacatttaaactacagcaaataccttgtcctgaacttttgaaactttaaagcaagaaggagactctttagttctgtgcattcttccctgttatttcttgcctgaggcaatcgctgtagccttggggtttttgctccagttgggcacccctgagcttaccacggtggctagaaaaaacatgccctcactgacataggcctgggagcccatctaggagccattcacagtggcaaggggtggcccttattttgcatagccaatgagaagactcccctggctatgagggtggagtccatcttaaccaaatgtcaaggttgctgccaagggaggaggaatggaatgaatgtgggggaacccattgggtctactccacagtgtcaaaggcagggatagtattactgggatgaaagagacttgagcctgtgtttaggtctacagacaggaagcgattaaagacgttggaggaaagagcctaaatttggttaggagcaaaatcctagagaacaaatgaggtgtacgggggagggtctagatttgaaatgaaggcatgaaacttctcctggatggaggatgatgaagagacctgctttgaaggtgtaagcgaaggaagggatgtgagggcctctaacagtcttgtgtcctccaggtaggaggagcagcgcagctggagatattggtagtgtggacagcttcatggtactttctgggaagtgtccaatgtgtaattttaattggctcttttcattaaatagaattgatattattttaagagacagatcacttgaaaattaggattttgattcacttctcaaatgaagagaaagtgcctttgcctcatgtatgtgtgcagaatttgggagaatacatcatgagctcagggaatgtgtatgcgaagatgtttgaaaagtcacttgtgggaatttgcctggcttggtggttaggaatgtggactctgaagccaggaggcctgggctcacatccaggctttgcagccttgggcaggctcctgaacacctctgtttctttgctaaacagtgggcaggatatcactatttttggtatagacctactggaaggatcagaagacttaatacctgtgtgtgttttggagagttattggcacatattagatagttttactgtgaatcatcattatttataataattctctgacatgctggaatgtacactgtctttagaaatgaaatttgttttgttttcctaatttcgtgcaacctacatttttccagtgctattttctttggggaaagagcatgcagatgttccgtgttttcaatgtagcggtgtataaaatgtcatcattgtttcctttctggtggaatattaagagccagcttaaagataatctactcccagaaagttccatattagcaattatgtggggctggtgctcatatgcctcaatgaatgatttatttattagtatattgggaatggcctccctcttctcacactagcaccttttccccactttccagcccatttccaaatgagaagggctgaagtcaatcaggaattaagatttagcatttgtgggattatctttgaatgcgacactgggggggacacagtttcactcactctccatggtggcagtccaaattgctctttcgggaccctggctgtgtctaaagcctcagaatgatccagaaggctcctataacagtgccactgtggaagaaaccacttctaatatggcaggaaggtgtggccctgcttggagcccatgttttctaactatttcacatttctttctttcatccctggtgttattttttgaaattaatttttattttcagttctcctaggaattaatgagttaacttaataaaagtaaaagtcttcataaagaaggtaaaggctggctttccacatagagaacaaacataacaacccacatcctctgcagagctcctggtcaatgcattcttctagtggggctgccacacccctggggcctcaggcaagcaagccccttgtggatgacaggggctgggctcaaagcagtctctggggctgtgcctccttcctgttctccactcttttctctaaaggaaatgcactgcaatgaattgcacaatacagacattcctaaattctggaaaaccagcaggctttgaactctcctgggggaaaaaacccataaaacacaaaactgcaaggaatgagactatttggccaaatggccaatatgctacaactttcatagggaactcaccgcacttggtattgcctgatggaaaaaaatgccctgaatttcccaataaaatatttgagatgtggcaaaggaataaatattttttccctaagataaatctagctgtagatgaaaactgggtctcatgcctcggacaaaatattatttccttatttactctaagtctatatcagaatatagcctacacagcatcaggtactaagccaaaaaaggctccaagggcaccattgttcatccatgactttgactgtgtcaccccccagaaaccttgagttgggcagatgtaatcacagcagcctttggtggtttcttgagcagctgctaaggatcacatggattctgctcacacccagtgcttctcataatttaaaaatgcttgaagctgtgggaggctgcccagccctctgcattattcaaaagaaaaccaggaggcagcgacaattcttgattcttgcagataaacattctccaacaattattaagagttggattgctctaccttcatttaattccttggtgctttactatttgaatctagaatattcttgaagtctgaaagatggatagaaaagaggtaagtcatgtaaacttataaacagggcacgaaccccgctaacagacagctttgaagagatgatgattttagatcttgtgaattgttatgtcagaggaatacatgcagaagaaaacaggcaccgaaatagttattaccagagcaaagtaaatctgaacacctaaaagaataagaaaatatcttatgcttctctctactctgaactgccttgaaaagagcaagaatttcatacatgagcctgtagcacattacaaaatctgagtatgtatttgaaattcaaatgcacacaaagttcatgcattttattttccagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacatgaagcattgaatgctttatacgtctccatcctgattgtttaggctttgaatgctgagaagtatctgcactttgttggtcaattgtagatggtgctaatttgtggggagtttttcctgcaaattccccctgtgccataatccagaggacctccctctgcccccagtgctgtaggctaggcagctatgggcctggctcagggctgtcgggcaaggattggactctctataggttccgtttggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgctacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactcagccatccttagcactggcttccttcctccaagttatcttatgcttcaagaaggctgctggagctcctgccatcacttctgcattccagacagaagagaggaaggaagtggagggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataataggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtcttctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgtggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaaggttagctagggattctagaaaagctctctaaaggagactgacatgtaataggcttagcattttgcacctgaattctctccttccccctgtctggaatgcagacgtgatggctggagctccagcagcctccatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctttgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattatcatttatttgtggttttcctctgattttaaaataaatcaaaattaaaacacttttgcaggcccctaacagtatcatgggccccatgcactgtgcccagcatgcccaatggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattccccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcggtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcagcaaatgcacccagcaatgtctgattgatagggcaccctctgtgggctttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcatacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccacgagtggccactagtggaagcctcaatgtctccacttccagtgggctctcaggcctcacatgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagatttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcccagtgatgaagccaccgccagggctgagcctcagctcagccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccacatttcatttgctgacacccaggggcagcattaggtgtagagtgctggacatctaagggaagaggttcaattgtccatctgtttagttatttactcattattcaatgaatgttaattgagaccagtcagggcagctgagaagcagtgcggttgtgaggagggctgttagtaggggagatgcaggtgctggtgtgcttccgtgtatgaatatggcagctagtgcagggtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctctgcccccgaagtcatataagcatagccacgatgggaaggatggtcataactcaacatgcccattcatataccttgagcacatatcctgtcccagagactgctgaattattgcatgagccccagctccttccacaccaaagcccttccgactgcatggacctcaccacttctgttcaagctcttccttcttctcatggttcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtatatatatatcttttagagacaagatctcactctgtcactcaggctggagtacagtgaagcaatcatagctcactgcagccttgaacttctgaactcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgacttttttaaaaaaaacttttttttttaacctaagtagaactttgcattatcgttggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaacgtatcatatgatcaaatatgtgatagtgatcccacagacaaatggagcgtgtggggatgatttagacactcagccagccttgtcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacggatgcttttcagcatctcttgggatgaggatacagaatttctctttcaccctgtaaatgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttcagagtttctttatgcaaatacagtataagcaaaaaagaatgggcctttttcttttcttccttattttccacaaaatctatcaaaatgggttttttttgttttgttttgtttgagacagggtctcactctgttgcccaggctggagtgcagtggcacgatcacggttcactgcagcctcgacctccccaggctcaggtgatcctcccatctcagccttctgagttgctgggactacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtggattttgagctgctttttaaacaaccttctccttagcatagacactgacactgaagggaaagaaagcaaatggtctgttcttagtgggaaggcaacttgctttcaggggaacgagtttgggggaagaggactggtagaagacacgactaagaaagtgagtaggagtccagacgtgtgtgattcatcctttagggcctctgtgtgtgatgggttgacttgtgtgtcccaaaattcacatgtggacgtcctcgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtacaccatgtgaagactggacttaaacagctacaccaccagaagccgagagagaggctggaacatagccttccctttggaggtagcctggcccggtgggcactgtgatctcagacttccagccttcagaactgtgagacaatattttattgtttaagccacttattttttggtactttcttacggcagccctagcagatgctaatccagcgtgcgtcctgacagaggttgaagggggcttctcaagtcccaggtccagcttggtgtggttcagctactcaagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccgtgcgaggttggcggccgagccacggttcccatgtgagcaggacagcacagtctcacctcacacagagaacctcgcccgaacatggaactttcacccacgttgccattttcccgctccctttccctcctttgaggttcacactcgtctctccaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcaccttgaaaatccggtggagtcagttacacaagacataaccgcacacaaacatggcatttctgatagtataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacaggagtgggccaaagagaggcccatggatccctgcccacctcagaaatgtgagcaggcagctggggggcatttggactctagccgggacaacctagtggccgggcaggggatgcaggcaccacaggtcacagtggtttgctacgagcgtcagcttttaaaattttaaataatcctcttattgtaaaattgaggacattatttgaagcaacgcaaaaaccatgtaaaaaaatgtctgtaggatgtgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccagtcaggcatatttcctcccaatcctgtcctctctgtgtatttggtaattgcgtaaatcatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccttctttgctgaagagttagttttatggtaaaaatccaataaaattgtagctaagcactgaaaaaaagtaaagaattaagctcagcctccagaaatactgattttatatatatttgctctggggaagattggtttaagaagacctatagcctgttaattgcccttttataaattgcctccctatattttttgccctcttttcccctccctccctcctttattccctctgtctcttccctttcccctccctccctcccttcattcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcacatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgactcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgccggacccgtggccgatgttgatatctgctcggccggcctcacaggtgtgcgcgctgtgcagtcgcttagggcctcccctgcgcagaaggtcctggcttggtttaatgccctgctgttaccatcttaaaattcttaatggtttttgaacaaaggccgcacatgttcattttgcaccgctttgtaattacatgatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaacatgcttctagtcacctagcataggtctctagggggcctctgccacaaggcagggccaacgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaactctctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgtaaagaagcaccctacctgggagaaacttactgtctagttgtaaagaaagcaccagggggccatgatgcccatcccacccatgttcccacccaaactctcctaaacccacagctcccaaacaagttctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgttcgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcgataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcagaaggctggggacatgtgtgtagagtcccaactgtcagatcacagtgttgggttgggtctttcacctgcaggggcgtgtgtgtgtgtgtgtgtgtgtgtgtgtgtgtgtgtgtgtgtgtctgtgcacatgtgtgtgtgtgctgcttagagtttttgagcaaagtttggaatgatcaatgtgcagctttagaataatgacttggtgggaagaattgaagtgaggaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatatcacactgacattttgagaattcagaacagatggcaacacctgggcccctgcctgtgcagatgggccagaaaaacgtgacatgtgtgaaggtgggcatggggtggcagcagtttctctcgcccaagcattaagagtgttacagagcagaactgttattacggaattggtgaagcacctctgggggactccctctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggtggcccagcccggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaagaacaggagataatttaaacagccctgtggtttggaagtcacaggttctgctgcttcatgttcatgcacgagactaagagcctttgaagaagatcacttcctagaccaaggctttatgtttggattaaatgcagctcctccagatcatctcccgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattggaaagtaatgacattgaaaagaagtgaaaaaaatcacaggtatataattcagcaccaaattgatgaggacacagaggtgaactagaaaggcatcccagcggaaaccacttacagccccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtggatttggatgtgcagtggtggtccgggtgtgtggagtgggggtcagcatgtgcaaaggcatggaggtcagcaaaccaaggctgagagcacaagaggttcgctgtgtgtcttccagctgcccagtgagcacatggaggtaaaggtgcacaacttggtaagcgacaggagtttgtgtggatcaggcctgctgtgacataaatatgcaaatgatgtggtccctcgtggtagcaccctcaggatgacgcactcttctaccaaaacatggctgaaaatttttggtgtgtgggggtgtaccctgggagcccatttagaagctacagtgaaaagagccctcattgcttcagctttgagccatctgggccctcccacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcctgctcctggcacagtcttttctctgtacgtgctcatgtctgtgtcctgatttccttttcctagtagggccagtcaaattggattagggcctaaagtaattatctcattttactttacttctttaaaggccatatgtccaaatacagtcacattctggggtgctagaggttaagatttcaatatataaatttgcaggggacacatctccacccataacaatttgtttttcgtaatacgtttaaaatacccatttctgggctggatgcagtggctcatgcctataatcccagcactgtgggaggatcacttgagcccaggagtttgagaccagcctgggcaacatagccagactctatctataaaaaaaaatacacacacacacaaacttggccagatacagcggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgtagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcagcgattctgaccagtagtcaacaattgcaagtatgtggaatgtgattctcctgctttgggaacaagggagctcccagttttgtgggcaggatccgacattcccatcataagggcggcctcacctgtctgtacctctgacacctcagtcagagcccttggagtcggctaggccagttttggccctccttactgagacctagtcattctgtagacatacttcattctcccaggcttgggcttctggttcaacctgtggctctgtcattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatttttttttttttttttttttttttttttttttgagatggagtcttactctgttgcccaggctggagtacagtggtgtgatctagattcactgctacctctgcctcctgggttcaagtgattctcctgtctcagcctccagagtagctgggattacaggcatgcaccgtcatgcctggctaatttttgtattttcagtagagacggggtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtttgcatccctaagcctcaatgtcttcatctgtaggatggaggtaaccataatgcctgtctcagaggctgctgctagtgttaactgtgggacacaacacagagtgaggcacagacgaggtatgcagaaaacatcagcttcgtggttttttactcttctgcacttgctgtagcattctgcaaaactattattcctttcctagactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggcccagggttcctttgaccacctcacacctaacaagttccctcactgtctctcactctcccctgaagattctaagctgcctctgtcctgctaaaactgtagacctgagaatgaagtaaggtgcttcaggtgaggcttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcgctgagcctgggaggcagaggttacagtgagccaagatggcgccgttgtactccaacctgggtgacagagggagaccctgtctcaaaaacaaaaaacaaaacaaaacaaaacaaaaaccaaatacacacacacacacacacacatacacacacacacataaaagtctcatattttacacttatgaagttaggtgggttttttttgtttgtttctttgttttgttttgttttgttttgtacccaaaagtacataacctactactacctacctttttggtttttttttttttttgagatggagtcttgctctgtcacccaggctggagtgcaatggcgctatctcagcttactgcaacctctgcctcccaggttcaagcgattctcctgcctcagcctcccgagttgctgggattacaggcacctgtcaccacacctggctagttttgtatttttagtagagacaggatttcactatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctgatgtcttatggactcctgagaagtttgtggtggtgattcttagagctcagctcccgactgctggactgtcggtcactgggcagaaacagaactcagttctcatcacctggatgccgtttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcagtggctcacgcctgtaatcccagtgctttgggaggccgaggcaggcggatcatgaggtcaggagattgagaccttcctgactaacatggtgaaaccccgtctctactaaaaatacaaaaaattagccaggcgtggtggcgggcgcctgtagtcccagctactcgggaggctgaggcaggagaatggcgtgaacccaggaggcggagcttgcagtgagctgagatggcaccactgcactccagcctgggcgacagagtgagactctgtctcaaaaaaaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacacacacacccacacacacacacccacccacacacacccacacacacacacacacacacacacacacacatccaattgattctgtttctttggagaactctgactaacacagtctccttctcagtattaatgtttttttcttggacagaaaatatagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctctcaacaggcagcaggcaccttttccctaatgaactgtctttccaggtttcactcaagccctttctatcagacttctaccatgcagctctgccaatttctttaagcatctctcccttcttcctgactgtcctgaccaggaaactccctaatctctaatatctaaagtcatgaagccaattgcatcattagatgcgcagtatatataaataacatttacttacaagaatatttttatagaaatgtatgtaaacatacttacatacatttctataaatacatttaaattcctaaagacttgtttgagcaatttaaaaaaaaaatgctccagtttaacttcctactacaattaggaatttggggcagggtgcataattgccagtgtactcacagtgactgcaattagaatgtgctgtggagtcagaggaactgcctgacagtgccgggcagttgaccctgggctgggttcagagctctccagtggccactgagaagtaggagagtgtttcctgcacaatcctgatttcttgggggaggaggtactactgcacgctgctgggaggagcctctgaaactctcctgggccaggtctcctcccgtgcttcctctccctgaggcagcctcacctcttgacgcctgtccccagcacacccttctgtagctttcctctgactcacccctctgtgtgtctttctctccaactcggggtcctgtcacctaggcctctctcctttttcctaggtggctggcagttgctcttcccttggttttctctaatttgatctctttcccacccttccagtctgccacagtcacccttgatatccgcagaatccaccctccttggaagggatgaggaagggggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttatccagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcttaggggttggtgggcagactcattcatgttcccatcccaggggtgcaggggacccttctcccttccccacatcagcccagggccacagaagctcctcaggaggcaaggaagggaatggagaggacaagagtgcctacagagtgggaaggagacaagcattctcaggtatttatccagggtaagggcaagggcttttctgcagtccaggacattagaagagtcctgaaccaagaactccacccctgccccgatatcagctgtttttattgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtatatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagcctgggtgtactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattctaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacaattatctgaatctcataaataaaataatgattacagctgcatggaattattcaggtctaaattcatataaacatatccctaacaaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagagaggattgaaggggcccgaggctgtctgtcctctctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacctcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacacacacacatgcgcgtacacacacacgagcgcgcatgtgtgtgcacacacacacaaattagccaggtgtggtggcatggtaattccagctactctgggggctgaggttgggaggatggtttgagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacaactcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaatcacaagtggctctagcatttatgtattctatgatattgggactcgtgatataaataatacaaatgcttttacatgcataattcaatttatactatgttttatctttaattactggataataaaaacataactactctcaggaagtgtgggggattgtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgctcttcattctctataattaatatacttttcaccgtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaatgttccagcttctgggccaggttaattatctgaattatcttatttcatccttacattgggaaccagatgtccccaatgcccttcagtgatttttttggtggctttgaggaaaaatgaggcccagagaggttatgtaacttgtccaaagtcacacagcaggtagatttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttggatacacatatcaggtggcatttattgctgatgacagtaaaagaaaagtgtaaaacaagataatttgtttacatttcaagatacattaagtttttttttttttttttttttgagataagagtcttgctcggttgcccaggctggagtgcagtggcgcaatctcagctcactgcaacctccgcctctcgggttcaagtgattctcgtgcctcagcctcccgaatagctgggactacaggcgtgtaccaccacgcccggctaatttttgtatttttagtagagatggggttttaccatattggtcagtctggtcttgaactcctggcctcaagtggtccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacatgtaactctgggtgtaaagtgagtaaaaatatgagacttagaagaatatttcatcatggtatgctgactggggatttcacttactgatactagaaaggttttgcatttcagaacacgatgaaataggtaatatttatctgaaagacgcagacaagtggtggaggaaccagacacccccagtgccatttgctggcttttatcagacagaaagcagaaaggagaaacatgttttatcccatgagaaggaaatattggcttgatgcctaccatgcccagccttgcactagacatccaggtagctgctccatggagaagttcacagggtggtcaggatagcacagggaggaggtaatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgacttgtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacatgacaacatagcaagtaggtggtcatctacaagccaaggagagagggaggcctcagaagaaaccaccctgccaacaacttggtctcagacttccagccatcagagctgtgaggcaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccggagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatccacacccatggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaagggggaggcccatgggcagcagaggctcaacgaactccgtggcctgacttggccactaggttttttcagctcttcagccactgcctgtaggaggctagctggcattccttccttggcccttagcttgcatggatcggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaatctgagcctgaaggaaaataaattccttgagttgaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccatcttaattttccttataattgttgtgcaattataaaagacaatctgagggacccgccttgacagcctggggtaatatcactgggagtaggatctctcagaatgctaaggagcagatgcactaagagagctgcatttcactccattttattggatcttttggtatatacgtttctgtgactttagttcaatgggatggactgttgcataatactgagggctatatgaaggaggagtcgtctacacttgtaaaaaccttcttctttaggggtgggtagtgtataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggtgcctgtagtcccagctacttgggaggctgaggcaggagaatggcgtgaaccctggaggcggagcttgcagcgagcccagatcgcgccaccgcactcccgcctgggtgacagagtgagactccgtctcaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatgaagtcaagatatttcagatctgtcttctcctcctggcccagtttttaatgctttgaccccattctcaaataaactcaaccctcatgatcccgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcattccatcccctgtgtgagatggcggcagaacagttcctattcagacacctgccctcatgcctcttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttcttttttttttttttttgagacggagtttcgctcttgttgccctggctggagtgcagtggtgcgacctcggctcaccgcaacctccgcctcccgggttcaagctattctcttgcctcagcctcccgagtagctgggattacaggcgcctgccactgtgcccagctaatttttggtatttttagtagagacaggatttcaccatgttggccaggctggtctggaactcctgacctcaggtgatcctcctgcctcagcctcccaaagtgctgggattacaggcatgagccaccgctcccagcattttgtttgtttgtttgtttgtttgttttagacagagtctggctctgtcacctaggctggagtgtagtggcgtgatcttggctcactgcaaccttcacctcctgggttcaagccactctcctgcctcagcctcccaagtagctgggattatagtcacccaccaccgtgcccagctaatttttttgtatttttagtagagactgggttttgccgtgttggccaggctgatgtggaactcctcacctcaggtgatccacccgcctcggtctcacaaagtgttgggattacaggcatgagccaccgctcctgacccaaaatacctttttctttttttttttttttttgagacggagtctggttctgtcgcccaggcaggagtgcagtggctcgatctgggctcactgcaagctccgcctcctgggttcacgccattctcctgcctcagcctcccgtgtagctgggactacaggcgcccgccaccacacctggctaatttttttttgtatttttagtagagacggggtttcaccgtgtgagccaggatggtctcgatctcctgacctcgtgatccacctgcctcagcctcccgaagtgctgggattacaggtgtgagccactgctcccggccccaaaatactttctgatgctgataaaatgttttgtctactcttatgcccaaggaacagttcctcccttagcagaagttagtggttaaagcttcctctatgtttgccagtcaagaatgccacagggccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcagggatagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgctgtgattgttctgttcagttttagtccctcacagcactttcggccatttagaaagacagtatttgttctgctagagcatttgcaatctgtttctgattagcttaactggtcttgaccagtgctaagttcacacttcagctttgatttatgccgtctctatctgcagatatgtttcttgttacactatacaagaggaggcctcttcttattgacttcttattttcatgtgaacgaggtaataggtatcaggaataattagacaaggccatacgcgctaatgtcataggagactgagatatggagagtaaataataacaaaattcctgattactagggcatagaaaaaaaatcataggcaactccccaagttgataatcccaaatgtctaggcgtccttctcaaatagggaaacgtgacattaaaactactcaaaataaatgagactcagtggtatttataaccatagataaaaaagagcaagggtcctggggaactgtgccaaggcccagccctttgattcacaagtatccacaaaaacagactgtacgggctgctttcaagagaaaatgtggccatcaaggtcaacactggaagccctatggccactcattcattccatctcattggccctgagcctttcgaaaagtaggcagagaagaagcccaaagaacaacatggcaggcaggttaaggaagaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaatacaaattcttacaagatgttgacttgtacagtgtggcaaggaatactgtcatacagttgtgccaaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttttcccatttatacagacttttgttctgctcttagataaaatactaataaacaggaagttgaaaaaaaaatgtggtgcaattgttctgaatgttgtttttcttgcaaggctttatgggctacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcatagctgcaaagaaacctgaattgcccaggattaaccacctttcctttagacggtgagcagtgtgtttcacgaacacattacacattttagggttgtctatggaggtatcggcactttcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagcggtatttttggaacttgcccacccccgttcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgaacctcatcagcatatttttatttttgacatttcatattttagagtggattgaaaactaatttgatccatttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtaggggacttgggtggtgtaattttagaactttactgttgggttgttggcttgaaagatccattctcttctataaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctatgaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacaacaaatacataatcaacttcagtcatctcattttcaggggagttactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaggggttagattcatagagaaagaaattagagcagtggttactagtggctggaggcaagggggggaatgaggagttattgtttaatggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcctttaatctagacggttcacgagttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgatttttgtaggtggctcacaaaacaaatgtcagtagccattctatggccttggagtatcatttcccacaccttttctatggactgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcatggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagaaaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcagagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccaggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtgggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccttgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggctactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctcctcaggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctccgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattagggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctcgaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaaggcctttttaaagcaaactatggaaaataattgatgagtagcgcagttttataaaacttttttttctattaccctttaaaaactatgttgctaactgcacatcacactgcattcatatcctgggactaataccccttgacctctgccatatgaattaaggtgaaagaagggtcataagtaacaaagtttcaaagttgaatgaaccttttttttcctgtaattttactgaccatttccctttctgtttgagagatctgtgcggtcctgttgctgaggttctgtggttcaggggtgttatcggcgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccatgttcctggttgaggatacctgaaggtcgacatttatctgggatcttttgctgctgctttggtatgacttctatcaagatagctttcgacgaggtagaacgtttgctttcactctgggttttccttggtttcgacaatttttaagtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggtatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggcgacagagtgagactccgtctcaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcaatgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttagtggaaaacagaaaatgaagtgcaagagaccctcatttccggggcaagaattctgagttccttggcttctttcattcttgtctgactttcccccctccagttgcagttatttctagattttggtaaattattcattgcttttaaaagagaaaaagctcgattttctaaatctacagttgagctagccctaacctctaaagccagattgctttaacaaaattgtcatcattttatacatgacagattggcttcaaataaaatggtaaatgggaggaaaagtatattttgcttacacttaggaatgcctgtaaacgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaaggctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcgtgtttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctactggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcacctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttcattttcaatctgttgttgaaattcagcaaaacaaatattttaaaagccaagtcagctttctaccgttttgatctgaatatttaatgctttataaaataaaaccctgtgttttaattttaactagtttcattctttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattattctttttccaggaaaaaactgatgaggttgtttcagaatttgaatttactagaattccttttttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaaactcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaaaagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctggctgggacagccacacctgcagagagggccctgattggggtcgtggtcctgccccacatctggcaagcctgtgcctcatgtactcacagtcaccttttttatttgatccccatccatcctaagtccccaccccaccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaactattttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcatagggttgcagtgaggagggttgagctggtgaaaacacttctgttctcctatttgagagagatgcagcagaattcatggctgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaactgcagcctagagccagggtgctggaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaaatggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacgtaagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccggcttgagatggtcgtcttaacagagccttgctctgttgttgctcgtgatcagcacctggcatctgctgccaaagactctgcccacatcagagactcttgatgtctgtccggaacaggccaggacactctcatccacgttgctctcattggattggctcattaaccctttcttctatccccttctcactctttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacctggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgataccaatagcaccaacctgagagggctggggagatgtttgaaggaaagcttggctggggagctgtagctggcctgtggtacatgcttggtaactggtggccaggagacccgggtgtgtgtcctgggactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctgatgtgagtcaagaatggacaggctgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagctcgtggtcttcacttcctcctaccttgagacttactgcgcagaaagtagaggcttggatggttcaacttcaggggcaaaacagcctgccttgggggtgggactgggggtatgcatctgtgccactgcttctctccctttgtcagtttaccatgccagcagccttctgtctgttatcgggaacagaaagagcacgatttgggagctagctggggagcttcccgaaggttgcctgagctgcatttggggcccctgatgagggcttctattcagggtgatgtgtgtgaccctgaggccatctctcagatctggggggaagtgaggttgtgtacccacagtggggagacctacctggcggctcatcaatattagacacctgcaggaacagcaggtcagccaagccaaagagtaagagtggccctgtctgtgactagacgcttcttcagggttgcctcaacaccggagtggcgctggtggtctccacccactcccagtgtacgctggcgtctaggaagccatgtgtgtgatcggccctgaattaggggcaaaacttttagttctcagatgaactgtcgtgggtttattcagtgataactagacagccaggccaacatggagttgattcatccatgcaaaacctcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcgatttttcactgtcactagccaatgaggcctttaaggaaaaaacagataagactgtaggagtttatatggatccgttaactcacttgtacaagacattgggaaagatactgggggtgggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgcctttggccacatttcctaacaccactcagcagagccctgccagcaaaggtcattgtgcaaaaaatgttatgccccatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcgctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgtacctgggaggccatgtctcccggggaggctcaggacctcattgggctggaattccacagggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgctgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacaagtgtgtagcctagaagcaataggccataccatatagcctaggcaggtagtaggctatgccatctaggattgtgtaagtataccctgtgatattcgcatcacaaagaaattgcctaacgatgcatttctcagactgtatccctctcattagcaatgcatgattgtatctgtaaaaatctaaggcccagacctcagtcttttggtgttcattctgctggtttactcagtttgcatcgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactccactcgttggggttagagatggagaattagaaccaaagctgaatcactttctgcttatcactcatagactgccagattttcttttttttgttggagggaaagcaccttacaacaaataataatactattttgaatttcagagctttccctttttcaaagcactttaccacctatgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttccctttggttccatcccaggtttctaaccttgtgcctaaatttttgggggccctttcttcctcagagctttgtgtgatctgcaaatttggtaaatatgccttcatttaccatgtctctttccaaggtgggtttcaccatgttggccaggatggtcttgatctcttgacctcgtgatccacccgcctcagcctcccaaagtgctaggattataggcgtgagccaccgcacccaacctccaaggtgttttttaaatggtgaatgggacagaacgcaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactagggactcaggagcagcctggctgtctgcagcagctgcaaagggagcaaaggcaagcaggacttccatgagctaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggagtgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagctttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaatggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacccctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcacttggcatcccttcctgctgcagaccccactggaatctcctcagaaggggacactggtggcttccattggccctgcctcccgccagggctgtgtgaggatccacatgggctgggatgagggtggatgttgttctctgaaaactgtccactactcaaaagtgatgttgtggccgggcacggtggctcacaactataatcccagcactttgggaggctgaggccggtggatcacgaggtcaggagttcaagaccagcctggccaacatggtgaaaccctgtctctactaaagatacaaaaaattagccaggcgtggtggtgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaatagatgttgctgggtcaaaaagggagaggccccaccctggccccctagcaccagaatctgcatttcagcaagatcccagggggctgtcacagttgctagctctgctctttatgcttgcctcagctaggtgctgagtacctgctagaggtgtgaattcggtctttattcttcagaggcactggtcagagggtggaaacatcagacagggactcctgggcccccaggcaggactccatggggatggagcgggggatggaacatttgagaatcaccaacatgcagcaaggacattagtgagaaatgagttccacctgccagaagggaagctgagaagggaatgcacaaatcaggaaaatataccatcaaaaactacgactcttctacctccagccctcgccaccaattcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgacgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacgaaagtgtgcactcaagcatgtgtgtttggggtgtgtgggtatgggtgtgagacatggtcttatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgtggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggctttgggaggcaggaatctctgaatggatttccttcctcctgccctgcttggataggggcacttgtggatgcttctggctccaacttttgtgtgcagtgactatgatggagaagcaatgagctccctctacagccttctgggctgctggcatccccagtatgtttctccctggagacactctcagtgaggccaattccaggctgctgggggcttttccttctgtcactgtcgggcctccgcagggatctgcctggctgcaagatgctgatgggtggaggggtggcccacctggcctccagaagcaggagctccctgcccactgcccgcatggccctcagccctggccctcacctgttgcccctctggaagaacgttgctcttgttagctaacaaccacctgactttcctcgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaagccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacaggcactgcttcctctccctttgacaggcaggacagcggcccgctcccaaatctgcagggtcagacgtggtagatgaacagtgatttgcctgagtgtaaatattgtgatgtctttcttttcttgaacttttaaccttgctggtaaacagggtgcatccagaattgtttttctgagaactgagttttgaggaaataggggggaaaagggtttttattagctaattttcagtcttgtgcgtgactcaaaaccttcttattctgtttcttaactttgcttcaggagacacttggccaaaaaatagctttgtttttaattgatgaaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacctctgccctgtaatttcatgaattgttcaatgaagatgtgacttattggcttccaagcttcatggaggtgttgtccaaatacaaggtccataaagtgctttggaaggcttggaggaacaaagaaacactcttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcagaccgtctttcaaataatgctccagttggaaagtaaactgagtacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaagagtgttaaaacaggcagcttgcgggaagccaattgctaacattctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggctttactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatgcaagatttgttgagagtggtacatttgaggatttatttgtaggctgtgttaatatactttcgagaaattcagttgtatctaattaatgcttttttccctttgattcattccaaactatttaaattggaaaattgtgtgctatttgaagatgcacttcaaaactccttttgttgtcatggtgcctgttgtcactgctttttgttggttggttcttgtttctatagggcccctcctctttgggatcgtgtgggtacagatgagactcacagttccctagccagatgatctatagaagtttttcaaagactgcataggtagtgttactgaacatagttcatatgtggtgtgtgtttctaaccttgcaagctccttgcaaaactacataaatacttgtatttaagttgtgctgtgcatatgaacataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaaccgccgggcagggcagagggaagtagtgtctactttaaatctgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtctttaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagtcagtttgtttaaccaaactgcttaaaatgtcaacttagtttgcaaaacagccctatgtggttggtggtattatctgcaattcatcaccaacacactaggcccagggcaaagctaaaagcaaagctaaaaacaaagctaacagccagagtgaccagaactgggtctcacctctgctacacctgtgccagggagaggagatgaacactctaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccatctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacgtcaggaagagcagtgtagtcagagagcgtggcaaccaccattcgcctggtagacagctcattccatctgccttgcatattttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttccttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacatggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcccattcccagtctctccatgaacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaagaccagagagtaaacattttaggctttgctgggctgcatggtctctatcacaatggctcaactctgccattgtagcatgaagcagccaccggtaatacatagaggaatggcagaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagaattctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagaatctcccagaacctcacaaatacccccgggctcctggtttgagggactagatgggaagcccccctccctgggagaacacaggcctagagcttcctggaacttaggcagcttggtcagagagtgtgaggactctgacaggagcacgggtgtgggacattcatgcctggaaggccctcgacacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagattgtggaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcattatttctctaattgaacgttacttttaaaaacagacaaagagaatcaggaaaaatgatgtgaggactttaggcccagatcagtttccgtttcaacaagatgtgtcaggatgatgaaaatgtcgtttggttgagccgtggtcatcaccccgcattgttgttctttcatgtgtttgtgtgtgtgtgtgtgtgtgtgtgtatgtgtttccctctgagtttcccagtagtcattactaaaaaaaaactcctaaactgactcaaaacaacaatgacaaaaacaaaagcaaacaaaaagacccaatcaccacaggcgccattcaggccctcttgtctgacggtgttcacagactgtgcttgtgtttttggatgtacccgcttccttttctctcttactcaccagatatcactgggaatccctccttcttgctccaggaccctaaaggagacactggggtaagactcatgtgggtcttggggcagcccatttccaggagagcatgacccccaccccccaagccccaggaggacggacccttcccagctgaggtctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaagtggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcataccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgcaagggcacacgcagggtgagtcttggagctggaatttgaacctggggaatggcactcctgggccttccctcctaactcatagtatctacaacctggattgtagacctagctagtaggtcttgggggttcttccctcctaacccctggtatctagaacctggatcgtaaacctagctagtaggtcttggtggttcctcacatggatggaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacgcatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatggacacaggagagcgagtgagcaccccaccccacaacagtgtcctgaggaaggcccctcttttgtcccctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacatctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcatgggccccagactcatgggaactgggggagtgcccaagtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggacctcggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccctcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgctgcctctcctttcttggtacatgccagcatggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcaggacttgaggaatccttgtagtgccaccttacaaatgggttggtgccttggaaacccagtcctggcatcaaggccttggcatctgtcaagcagaagtgtgcctggggtgtattggggggggggcagtgttggagccgatttcaccgatttctgtccctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtgggggtggtaggctggcggcacaggggctgctgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttctggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagttcctctagaaacacaagcatagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagaagagcttctccctcctggtctttaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggaaagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacagtttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttattagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacacacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctctgtgtgtgtgtgttcatcttctttggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttccttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttatttcaaaggtcaaactccagtttctctctgccagtgctttcaatttttaaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataaattataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggtgaatgaattttgattgagcacagattcatcatatcttgccaggtttgtcctttatttgtctccaatgctgatgcatctggattcacatcaactccatccactacacttacaaaggcaaatgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgtgctgtgtgtgtgagactgaatgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccccactagatgtggcccctccaccttggatttcttggcctccagaagaaaataataaatgcctggtttcgagtgctctgttatatgccacagaaaaagacaggagtggagaggcttataacccccaggatggccacaggcttatatcccttttatcctcaggggtgaacccttgcctacctgtttttccatccagccaggccagcactgtagcagagggaaaacccaagggccccatatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcgcaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacactggtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttagacttgtccatttggctctgtggatatgggttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagacttcatctcaaaaaaaaaaaagaaaagaaaagaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggagctagaggccctcgtccttagcaaactaatgcaggaacagaaaaccaagtatcacatgttcttacttacaagtgggaacaaaatgatgacaacatatggatacttagggggaacaacacatattggggtctgttgggtgagtaggggatggaaggagggagaagatcaggaaaaataactaatgggtactagtcttaatatctgggtgataaaataatctgtacaacaaacccccatgacataagtttacctatgtaacaaacctgcacatgtacccgtgaacttaaaataaaaatgaaaaaaaacagtgatagtacctacctcatagtattgttcttggaattatgttagccattatataattcttaaagagttcttggcatgtagaaagtactatgtaagtgacagccatcgttgcttttgtaatgattattttgcttcctttctttttgttcattgcacatttaaatttctaaaagagattccaatgtctttattattaaggtgagaggaaagcctgaatttaccttccccctcttcccagctctgcccctcacagcccccagacctttgctttgcttgctggacccaaagacacacaattcttgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccgcctccccatcccttgtctgatggctagtctccctcccctgagggccgacgccactgcttgccaattttgacataaggcttgaaaccaatgagtgtccagtgactgggtgagtttggttcctcctacttgtcttggcaatctcaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggtctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagccctgggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttacttctcaggcatgagccaagggtcacattataaaagctatgccagattccccatagatgatcctctatccaaaaattaggagctcttaagtcataagatgagtcaaatctacccccttagaactcaacatagctatgttcagttttactggaaaataagtcactggaaagcactttttatggttttctaaatctctcttatgcccaaagaagtggttcagccctggtctaaggcactgctcacttactctgattgccatcttcagcatcatcgtgatgatgataatgatgatgatgatgatgatgatataacaagatagtagcaataacaagagctgcctcctcccagttgtgaaattatgtttatggatatctggggctcactgttctctttaggaatgacccctgagggctcatggctcccagcccccagtaccgcaggtaaagcagtgaccctatctccagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatcgactgtttctttttggttgtaaaaccctgaggatctctctgcatttcttcccttcccacccccattgtttaagcctcagtttctcctttgagctacctgggattctgatgggcaggattgctcggtaagcgctaagctctgtccacaactcagccattttgtgtctctggtttgctttggatggcagttttccccttatcctgcccagatttccagtatccaagcccgttattttcttatattcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggccgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcgtgaaccctggaggcagagcttgcagtgagctgagatcgcgccactgcactccagcctgggcaacagagcgagactccgtctcaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacaggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaatttccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctgggcaggatgcgggagaggcagctgagctgcttattcctcagtgtgagggctgctgggagcgtggggtgcagctcagcttggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtggcagatcgcttgagcccaggagttcgagaccagcctgggcaacatagtgagacccttctctatataacataaaaatttaaaaaaaaaaaaaaaaggagaagaaaagaaaagaatctcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagcggcaagagaataatgaggaaaaagcaaaagtggaaacccctgataaacccatcagatctcgtgagacttataaactatcatgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagatattaagagggctgccaagggaggaggagggaggggttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacatgatgtatttattaccattgaacaatacacttaaaatggtaaagatggtaaatcatatatgtatattttacctcaataaaaaagaattaaattaaaaaaataagcaaaacaaacgatcttattttaccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcacttttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctatttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagaaaatatactgtgtgacctttatccagtttcccctaaagataacatcttatatgatagtataatagcactgccagaatattggcattgatatacttttacttgtcctcattgtgtgtatgtgcacacatgcatgtgtatttagttccatgcaatcttatcccacatgtagggtctgtgtatccatcaccacagggttcctcttgctgcctttttatagccatacctccttccatactcttctccttaacccctggcaaccaataatctgttcttcatttttataatgttgtcatttcaggaataatagactcgtggtgtgcatgtcttttttgctcagcacaattctctggagatttttccacactgttgggcacatcattatccaatgcccccttttcttgctgagtaggactctatggagtggatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacagacatgcctgtgaagaggccaaccccagtgtgcagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcacccccaacattctgtgcctatgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagagactcccaagccagtcctcacatatcttgctctcattactagggcagagggttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggaggttgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcccgggcaggcgacagagagagactgtgtctcaaaaaaaaaaaaaaaaaagagaaagaaagaaagaaaagaaaagaaaattagcagggtgtggaggtgcacacctgtagtcccagctactcaggaggccaaggtgggaggattacttgagcacaggaggtcaaggctgcaatgagttgtgattacattgctgcactccagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacatgaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccatgagcaaggcactggcagatttggtatccagtgagggcctgctctctgcttcataaatggttccttctagctgtgtcctcacatggtggaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacaccaaaacctgctaatgacattttaagaaaggaaaaactacagaccaatatctctcataatcatagatacaaaaaaatctttgaaaaaattattgaatcatattcagtaatattatataacataaccaagtgggattcattccatgtatacaaagctggtttgacattcaaaaatcaacgtaatttaccatatcaatgggctaaagaagataaatcacatgactatatcaactgctagagaaagtatttgaaaaaaatcaatacctatctacaataaaatctctcggcaaactagaaacagagggtatctcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaattttaaatgaaatttacattaccatttacaatagcatccccccaaatcagtatttagttacaaatttgacacaatctatggaaactgtaggcaaaaagctagaaaatactggcaaaataaaataatctaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaagcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaatagagaagttggactttattaaaattaaaaacttctgctctacgaacaattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtaaacggatcagtggtttccaggggcctgtagagatggaagagtagagtaggcaaagcacaagagatttttttttagaatggtaaaattattgtgtatgatactgtggtggtgaatacataacactgcatttttcaaaacccatggaattttacatcacaaagagtgaaccttaacatatgcaaattaaaaaaataattaaagatgttgggggattccaagatgggatgctgagtatgacagaagactaactgtattacaaatgtataaaataattccactgaaggggtgggaggaaagcgtgctgaccaagtggcattggaagtgagtggagactgtaagactaaaaacataaggaactgtccacaaccctgtattctagtagataaagctctttcccaaaaggatataaattctgaagccactagtcacacactctgaaatgtgaagtcactggatggaggatggtgggagccaggtttatctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcaaaataaatttccccccagaactgaacagaacttcacgtacccagttaccatgacccacgagggtcatgaggcacatgccggtactgacatcccacatcttaatagtcttgtccctggatccagacagcaagaatggcccagatttaccactattttttagtctcagagcctgttgcttcagagatggaggaatatgagctttctggagcccaggaaatgcattctaccacatgctcatgttctcggagctcacccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctctatgtccttcctttaagagttctttcaaaatctccagtctcataatcccacaccttaactgtagcatcctctgaagcagagaccataacactgaacacaggatggaaaatgactcgaatgattggactcctgtgaccactcaatgtgtattttttctggcagaaaatacccattcttttgggtcttgtttctgaccaagaggtccacctgacgtaaattcttcttttgcttcatttagcgttgattctaattccataaacttcttttgtaatctaataacagatgtccattttttccccaaaacaccagcctactttatttcttcattcatatctaattcagcttcctttttaaaaactgaatatgcctcttcgtagccatttgaacgaagataatctgctttagcttgatttagttcatctcgttgtctctgggacagcaccatcttggctgtaatgtcaagcttatctcatatagtggtatgtccctcctttgggaaatgaaaaagctttttgatccgtggacgtataatataaatatgacactaagtgtcttccactcagcggaaaatgattcttttacaaatgaatccaactagtaaccagaagatattcaacaagtaagattcattctactctcccggccgctggattctgccactgccccgccgctccagctctgtctgtcacaggagctgccccaacaccctgacgtcactgtgccaccaccgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttagttaatcacatacatatgaataagtaaatggcagagaataggcacatctccagagtggtggaatttcaggtaatttatgtaatagtgcacccccaaggaggtggagcataattctcccctccttaaatatgggctgcacacagtgacttcctttcaaagtgtacagtgtggaaagggggcaggggagaaacttcacagtggagacgtccaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatggtgttctatggtggaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctctctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaaggtgaaggggaagctaacacatcttcacgccggagagagagagagataagggggaagtgctacacactttcaaacagccagatctcgtgaactctatcaagagcacagcaaggcggaagtccacccccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcatttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgcccagtgcatggcacttttacaagaaatcttatttggtcaaccccccaaatatcacagaaggacattattattatctccagtctgcagttgagaatgctgaggctagaaagtggttaccactaaaagcaaaccttttctctctttcccattgcctatccaccctgactctgggctctgacccatacccacctgctcaaggtcccaggtaggagttgcccattcttttaagtatgagttcattcatacacatcaccatgtgaggcttgatgtgacctcagtaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccatgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggggtctgtgcagcctgattgtattggggatgggcccctcgtccagttgcctatgaggataacctgcggagaagatcagatggagatacctggacttatgcagaggcgtgttcgggttaaatagaaatgcccagggtccaatagagggaaccttccaacaagtgtatgagttggcctctcacccgacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagggtgccagggattttggtaggttccgtgcggacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgaacttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggttaaaacaataaagcagaatcgatgtctgtagaacagagctggaaggggcctcatggttggttttcaaggtaaactaaccacagacatcagttttccactcctctgcctttttagcatctgggttcatcttccaggaaggccataacaaaactccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtccgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccactgtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccaccctcgatggcagcctgcccgctgcgggcctgcttgtctgctcaaagcagaggttgacttgcgcccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcagagcagggaattaacctgctgcccagggccgggccagcgaatgcttggaaggaaagcaaagcgcacgggtgtgcattttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagggctgggcctctctcaggaggtgaaccatcccaagggtcatggaaagagctactcattgtgggcctggggtgacagtgacccatcctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcacgtcccactgcccagggctgggaaggtccagtgtgcccagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaactcaaacccaccttgtcacccctctccacccaggccccacttcctgctttgctggggctggggggtcagaagtaacatagctagagacagatgtccatcatctgtgcttgtgatgacaaaaggaggtaacaggagtacagtcagaccctcactccttggagccctgttgtgagccgctcatggcatgcaccattctctgtcctcacaacagctcagacgggtaggaattattggattctttctctaaacgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctggctctatctgtgaaatgtctcaagagtccatcctgttgtctcccatcccatgtctcccacttggcccacagtccagactcttacctgtccagactcctactccagagagagccggcaagatctttgggaaaggcacattgagccatgtccttctcccccttggaactcaacagtggcttcctgtcactctgagaacagaatgcagcctcctccctgtgcatgacaagcacctccctgaggtcacagctgtgtctccctgactctgcactggtccagtccagcctcaaggccttaaatttgccactccagacccctggtttggaccctggactctgaatacattctggtcttttcctcagggaggtcgaggcactgtcctagcttgtgacctgctcccatacctattttctcagggtggaagcagacgctccaactcccacactgtgaggctggtaccattacctccaagacccaaagcctgtaggaagtatagcaggcctcacccaataccctgcagttccctcacttgctccaagtgggaggtgggtcttcacgggtccccaagatgagggtcagtggctttcctctttcacaggctacagtgggagcgagtcttccaccatgggacctctggccagatctcagggctctgtggttgggggaaaatggctctctttcatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggttgggttaaatattcagtggctgcccacacaccacttactctattgcttcaaaataattggctttcacttatcaggtctactagaatgactgtcttaaaccagtcacgtggtggaagcgtcaccatgtttcttgctcagaaaataccctttcaagggcttttctaggggagccggaacagtagccaattctagtgggacctttaagaaacaactttgcccaggatgatatttgagccccctaaagggccaataggggtccctctattcaactttccctccgagtcccaccaacctccccactttggttccatacagcttggattattgccctactagttcaaaactgaaagtttcaaataaaaaccaaaagacaaatgttaagtcacattgaattgataactgagacaatctgtcaagcatattttgctttcctgatttttcaaaaaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggtcatgagactgccattcctgtgtcctgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagaccctgtggatatttgagtcatgaccttgcctcaaggcttattcatgtattatttgtttatttattgttaacataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattattggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacagcctcaagagaacatggagtcctttgggatgctgaaaactgtaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcatgcggagaccaagtgtggaggggatttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctatgaacacagagtgtgcatttgatggacagtatttgctctgagactgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccattagaatggctaatagcaataaaacggaaaatatcaagtgttggcaaggttgtggggaaattggaacccttctgcacttttggtgggaatatgaaatgctacagccactgtggaaaacaggatggcagttcttcaaaaaatcacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgcgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctataatcccagctactcgggaggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggaaggattcaaaagagaggtgcacattcagccagacactgagcctgttgcccgtggggattatgcctaagaggaatgagataggaggggttatgttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggacgtgagggctgcaggtaggagtttgatggcagatgagcctcaggggttcaatgtcagctgggagaagcaaggccacttccagactcagttctgccactgtctggcagtgaggctctgggcaaaccattttgttttgtctctggtaaaagaaggctgtgggcaggattgggctttgtaattgccaaagattccagatctttgaggggctctgtcttcctaaattctgtgcagcctgctagcctctgcaggacagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggaggtgagattagcttcctgggggcaaaaaggagccatatttgtcttaatgaggagaaaagagcaaaatcaaagcattcaaagaggataaaagaacacttcaaagaggataaaagaacatgttcagttcacaattactgcctccctaaccaggcaagtgtatgatggagaatcctgttatcctaattcaagaggacaatgccaaaggcttctcttgctggctgagaattgttggggagctccctgcccacggagggcctgtttgccagatccccagccccctgcagacctctgatctgtgaggagctggttctagtgattcacacttgcttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctattccaccagcaaatcagcctggtgagcaaacagctgccttagacaaatggggttgagtgtaggggtgaaacctgctgcaggattttagtaaattctcagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgccttttattttctttttattggatgagaagactttgaaagacacagaaaaacacagagaataacataaatacctgtgtagccacattctaggagtaacaactgtaatattttataatgcttactgcaatttattttttaaaaataaaataactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtagaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttctcatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattactgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtctcagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtactttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctatagaagccagctccttattttaaatcccatcctgcttgactatcaaagtcagacagagccttcctaaaagctgaaacacacgcacagaatgagaagtccctgcgggagcaagttcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccatctgcctgctgagtgggcaggggcccaagatcgctgtgggcaattccaagccagtactgggagctgacatcaaaccaggaaagaacacgactgtttttagctgatgtagcagtacattttctttctttccttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaattggggtttttataaacttttataatcacattttctgctgaggttatagatgactccaagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaatgtacttgaaaatatgttacttcacattggaacattcaattttatcttaaggatataaatattcaattttaccacattaatctttgtactgagataagccaaaaataacgtaaactgacaattgtttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtattttttttttctgttataaagggccagggctctatccgttggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccaggaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagttataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggttttcatccgtgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacaaggttgttaagcttccagatagctgaacatgtggaggttcctggagagtggtgcacccagggagggcatggaagctccgtgaccctttctccatacctcaccctaggcatctcttcatctgtctcctttgcaatattttttaattataaacccgtaaacataggtaaacatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtttggttcataggtatatagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagaatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcatcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaaggaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccatctaaagaaagtatgcaaaaagaaagctacagatcaatatctctcatgaactttggatgtaaaaatcaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcgaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgcttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtcaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggatcctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaattttaaaaaaatcactggattctactcaatagtagaattgatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaatcattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcaatgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttctacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggtttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaaaacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgtacccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttcttttttttttttaaatggagtctggctttgtcgcccaggctggagtgcagtggcacgaccttggctcactacaagctccgcctcccaggttcatgccattctcctgcctcaacctcccaagtagctgggactacagcgccactacgcccggctaattttttgtattttttagtagagacgggatttcactgtgttagccaggatggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgagggcagatgatcacccgctttaggagccattcttccaaaatcttaagtgagtgaaaaagaagcagagatagctttttgtatttgcgcatggaggcagagttcatctgttgcctgagctaacagtatactattcagcccctagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccgtttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaaccctaaagtataaaactcattggtaaagcagacacacaaataagaaagagaatggaaccacatgttatcattacagaaaaccaccaaactgcaaagataaacaaaggaaagaaagaaagaaagaaaggaaggaagaaaggaaggaagaaaaaggattatttaaaattatcagaaaacaattgaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaaaaccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttagcaataatctatttttaaatcaggtgtgtatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgatgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcacttagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaagatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaagtaaaataactctggtaggttctatagcaaatgctaagtaaagtaaccgctggtttctaaattattacgataatctgagaaaattatttctttgaaaaaattatagaactttcaaatatgcaaaaaactctagagagtaatataacaaatgcacttaatagggacaacctttaacattcagcagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcgtgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaacttttctgtccataaactcattgtattagtccattcttgcaccgctataaagaaatacctgagactgggtcatttacaaagaaaagaggtttacttggctcacggttctgcaggctgtacagcgagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccacgataacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtgctgggggctgggaaccagtgggaataaatcctatgggtctctgcccttgtggagattccagagtagggctgcccggatgttcttgcattgtgcacagtgcagagacaggaggctcccggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtggctccaacaccatacttaagcttacttcaaaatgacttatacatctctattttccttaaagtatgcgcacagataagaaaagatggggtgaattttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcagcctcccaaagtgctgggattacaggcgtgagccacggcgcccggccaagatggggtaattttgatgtccagacacaagttgtcatttaagatgaagcttcgattgtaactctatgaagccctgctgaatattaaaagcttatagaaagcagcttttctcccccaggcaaaaagagcccttcgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggtggtgcatcaagaccacagaagccggcccggccagccttcccacaaagttacttgaactgagctctccataagtacacatgcgcacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttgggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggcggaacaaggctggaaaactggtgcatggaggaaagaaaaaaaatgggaagggagaatggacaggtaggaaggaaggaaaggaggaaagggaaacggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaagccttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagaacgtcttaaaagatatcaactttgactcagagatttcaagaagacgctctatccgaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataacatcttatggaaactttcagagtttcaccagacaaaatgccccaggctttggctttgcagctggtgtctacagctgagcctagtccttgaagtaatcatgactcagcttattcaaaataaactcttcaagaattgcaaactctcctctcagcgcatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattttgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgattgtgcaaaaaaggaagtctctgccaagaaactaactgaatgttagtgcctgttctcaggactttccataaccctgctctactaggattcctttcaccctctttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacatgcaggagtatcaggagcagttagagataaacagctggctaataaacacatgaaaagatgctcagcatcattggtcattagggacaggcaaatcaaaaccacaatgagactctacttgactcccattaggatggcgacaacacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaatgttttggaaacagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcagggaaggtccctcagacataaaatactcacccatttagaggaatgacaacagcaaacgaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccgtctctacaaaaaatgaaaaaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaacacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagctcgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagagagagaagaccctgactccaagccaaacccttcaccgagggaaatgcaccaacactcagagggttcttgtttagtaggtgagcaagcagccaagcattggccttccccagggcaggggcataaggccggtgagcagctgagccaggatttgaacagcagtcacccttggtgaggcagaagcagatgaggatatgaatggggatggctaaggaaaggtgggcttgcttgcactggggagaggccttactggggattcagaattgagggctggggtttgcttccccggagggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaatcatttctaatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacacccccgtgggcttggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacgatggaatgctctaaacacgaggcctcaggggacagccccggtcctccttgtcagagcctgctctagtttgggatccagcaggaacctcaggagcctccttcactttggtggagaggactgagactcagagcccccaagcgcaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcttgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagcctgggaagacctctgctgacattccctatgaccactgtgacggtgcccccttcggctgcctcccccctccgtatggagagcgttccagccccaggctcccagcgcctgctcccagtgcctgctccccggcctccatcactccacgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttctagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacgtggtgcttggcatttatttattgtttatttgtttatattttgtttttggtttgtttgttgggtgtctgggctggccaggtgaacttcattttctgccctcactgagaggttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagtggccaggacagggagcagaaggtgactgctgtgctgcctggagctcttctgtccggaggcttagtgaaactagagaaactcagtggacacactacaagacttcagagatactttttgtaaacccaggaagaatcaaagatatgaaacatgcagtaggcactcactaaatgttaattttcttcctttttaaatatatgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtccctgcactggagttgccagcaatcacacgggaaggcctctagtctagagagacgggtaggagagagacgggagcacatcagaggagcgcagatgctagtgcacgggttaaatagtctcttacacatctggttaagatcacctcaaattgctgtggggttccatagctctctacagcccaattccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggcgtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagccgtggggggtctctgtgcgggatcacccctctcctaatacccctggtcccaggagatggggaggatggagacaaggccggtgtgggaatgaggtggcaggcttctcaggacatgagctgccttgctctgcccccttgggcctcatggaccccattctccctgctggagttgatgttctggcagactgggctgccccttggcccagttcctggaataccaagtaattaggtcatcatcggggcagcggaggccagcctctgatattctgcggcatgttacttgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttgtacagtcttctgtatgtgtgatgcattttataatatgagtggtatatttcacaatcaaaaacacttttaagaagctcttttgccttggctaactctcgtttgccgtttccccagggccagccagcccggcggagcatggggaggacctgaatctgccccggcactgtcctaccctccacaacatgctcaagtcacatcctgtcctgctttccattgcctctggtcactgtcacttgccaacattctgaacatcccactgccttcaaccctccccacttgttcggcacaatatggaaagtgaaaaaaaaaatgagttgcagagagccttgcttccgggtttggaatccagctccatcttgagtctgtttagagaggtatgagtgctttctgacgtagggcacttatcactttagcacacagggggctgtgtgatggcccagtaagagcctgagctttggagttacagagcctgggccttctcaactccatccctcatgggtggtatagatggttcttccctccctgctttccctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacgcattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccaccctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaagtgagaaaattgaggtaacccatgggcagagcacagggcactttgtgagcactcagtaggtgcaggctcctttctcctcccctctgcctttctctccccacttactcctgtcaagtaacttcacctctcagaaagcagcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagctcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgcagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtaccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaattgtgtgaatttagactcttggtagatgctgcctgaccctgggctgcctggagcactgcatccctgttgcctggcacacagtagggttattgtctctgagtagctgggtgaatgtaggtcagagctgggaggcgctgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccacactgcaggagctggggaaagggaaatgtggtaagaggtgaggaggagaaggacctgatggtgaggatatcacagtctgatttttattttttaaaggacaccttggttcctgcaaaggtgggaggggaggagaggggcattggtgagtccataggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcctatgcttccagggggaatgattcacaacctgggaaacctagactttacacactggcttttcttcttgttttaaggtagagagaaattcttaattgtaatgtggtcaagtgtgtcagccttttgtcgcttggtttgtgctttttgagtcttccccaagaagtccctccttctcaccatgaggtcataaaggtgttctctcgtgactggaaattttcacgtttccacttaggtccttgagccatctggaatttgtgtctgatttggtgcaatccagctctcctacagcctggctgggagacttggagcaagtcgggctccctgagtccccagctaacagatgagaagattaattaggccatctctgtggcatcttcatcacctacagttgcaaacattcagtcttccttgctgcagcctgtgaccagggtgatagtccagtcagcgtgataataaaataatcccgccgacttccatgctgcaaaaatgcagccacgctgacatagcattggctgtcctccccagctctcttccagaaacaaaacaaagcacctcaaagcaggtttcccaaggcccactcacggccagaactttgctttaaatcattccccttcgacagtttagttttaactatactgtatgtacccaagccaaggatgggaggagaagcctcagtaactagaattgttattaaaaccatatatccaactccactggcttttctggaaacctctacctaaaggacgtttaagtcgtctattaaaatatttcagacttgccctgaaggaggcaccaagaagtgccacaactttgcaggctagtgaccacacagatggaaatgtgtctctggaagcaagtggctggtgttagaaacacacacacacacacacacacatacacacacacactcccacaaataaaaatctagtcttccgtgttcactcgaattattgtaataatcactgaggatgtgagactctgtatttagtcagttctctaagtatgacccagcccagccgtaagaaaacatgggagggatgggtgaagaccccacagaggagggagagcctgactgaggggagccagccttcacaggggtcccggtggggatgcaggcaagaaactcagcccaagctcatctaaggtggaaggtatgcgtctgatcaagatacaggggcagggaggggtggtgtcctacaattctcaagggcctgagaaggaggccaggagcaaagttgtctgcccatcaggtccccaggtcctaccaaggcagagaccagctggtctctctgtcccagtagaaaattcctctggagagagaatctgattggcttgagatctgtgattaattttatgtgtcaacttaactgggccacaaagtccccagatatttggttaaacattattctaaataggaggctgggtacggtggctcacgcctgtcatcccaggactttgggaggccgagatgggcagaccacaaggtcaagagtttgagaccagcctggccaacatggtgaaaccctgtctctactaaaaatacaagaattagctgggtatggtggcgggtgcctgtaatcccagctactagggaggctgaggcaggagaattgcttgaactcgggaggcagagattgcagtgagccgagattgtgccactgcactccagcctgggtgacagagcaagactccatctcaataattaattaattaattaattaattaattaataggggttttctggatgagattaccatttagatcaatagactgggtcaagcagattgctactgtggtgggcctcatccgatcagtagagtcttgggtagaacaaaaaggctgaccttctgagggcaagagggaactccccctgcctgagtacctttgaacagggacactggttcttcctgggttgggagcctgctggccttggaacaggagctacaccattgggccttctgggctcaggcctttggactccaacaaaggcctgtgtgagaaatgatgtcgagaactggtcagttctcctgggtctccagctcgctggctgcaggtcttggaacttgtcagcctctgtaatcacatgagccaattaatgcacatcctactcttctctcggctctgtttctctgggggaccctgactaatccaaggtcccacagaacacaggtgactcctcgaggctcatctctgtggatgggagaggcagttcccagacaagggaacatcatgagtggggcagacacccacagaggcctacagtggccacttcactccaggagccgcacacctagctgcaggaacccgagccccagtgactagcgctcatgggaagggcctgcatcccagatatgtgatgacagcccatcccaaaggccagctcagaaaatgctaggatttgccttcacccccagtggggtcatgtgtatgaggggggcaagtgggaagggagactttggaccccaggccctgcccatcagccaccccatggctgaggggtcacccccataagctcttgaatgccagcacaaggcagtctggggaaacttggtgacgtggacagagcccctccttcagggaagtttctagactgggctgtgtgcttggagccactgtgctgggcacagcctcccccagttgaccatgggctctccaccatgtgctcctgccttagaatcagcctccttctctgtaagtggagatggccctggcggcccaggtatgagaggccccaatcaatggcacttctcccatccacctctgagctagcggggaaataagacacaagagtgaggcaggaaaagaccaaagcagcaacagccagggcctcttcccagtccccagggagcccctcggcccctacccactttcaaggccagcgatataataagtttgtttttgttttccaaataaaggtttatttctttctgcttaactctttttcaaaaaatttgattttattgtgctaagaacacttaccgtgcaatctcccctcttagctggtttctaggggcacaatacagtcttgttaactctaggcaggtgccatgcttcatggccggtccccagggcttattcatctcactgcactgaaacttgaggctctttgagcagcagctcttcagtcccctcccccagcccctggcaggaccatgctcctgtctgtttctgcgagtttcactattttatatacggcacgttagtggaatcaaacagtgttttgtgtctgccttcttcacttagcatcatgtcctccagattgatcaatgttgcagcatgtgtcagagtttccttccttttttttgaggctgaataatattccattattccattgcgtgaatacaacacattttctttatccattcatctgtcggtggacatttaggttgcttccacttcttggctattgtaaataggcttctaggagcataaggatgctgactgttttggataaatacccagaaatggggttgctggatcatatggtagtcctctttttaatttgtgatacgtttcatctctcactctggcgatgtctgagcttctcccttgatagaggtagaaagttccagagaggcacaggcaggcccgcagtgagaaggcctgagcctccttaccagggtatttctcccccacgggctgcctctcgctaactgcacagctcaatcacacgtcccttcccagggctgctgtgtgtcacacgctcacacccacactcgctccatctgtgctgggtcgaagagtgaccctgtatccacatccatccaggacctcagagtgtgaccctacttggaaatagggtctttgcgggtgtaactcattaagatgaggtcatactcttcatgttggatggtcatagtacatcaatgcctgttgttcttatgaaaggagaaaacagcagggccaggtagctcatacctgcaaccccagcaacttgggaggctgaggtgggaggcttgcttgaggtcaagaatgtgagaccagcctgggaaacatagcaagactccatctctaaaacaattttaaaaattaaaaaattagctggtggcacatgcgtataatcccagctactggggaggctgaggcaggaggattgctggagcccagctggagctgcagtgagtcgtgatcacactgctgccctctagcctgggccacagagcaagaccacgtctctacaaataaataaataaataaatgttttaaaaagagagccagggtctctctcttctctctctctctctctttctctctctctctctctctctctctctctctctctcacacacacacacacacacacacacacacacacacacacacacacacacacacgagggaatgtggtatggagacagaggcagagattggagtgactcagcccctccaaagagtgccaggaattgcaggcaaccaccagattcaggaggaggcaagtaaggacccgcccctgcaagtttcagtgggaccatgaccctgcccccacctcgatcttgcacttggagcctccatagctgagacagagtaaattgctgttgttgttagccactcagttggtgggcatttgttactgcagtcctgggaaacaaatgagccgtccactcactcatatacagcctacttctattttactggtgctttctgctaactcctctcctttccatctacatatttcctccttccagatctccctcacctccctcaagaggggctctgtggccaggaaacttttaatgagatctggaaaaagtgttacttgcacattaaatccattattttatgaatatcatggcttaagacaagctgaagtttaaaagtgagtgatttcaagttgatcagaagaaaaatatcaagtaaatggggtgcatggtgacacatgagttgctgaaatttggggagcactggaatgcaagaaacagcactgattcagggtctgtctgtaattctgggtccaaattctgctttccctactggcactgggacacacaggcattgttgaagtgctggaccccagatttctcttctgtaaaatggaatcacagggtctaaattggaggctttctctgaaggatgagaataaagttagaatgagaatgttcctagcatggtgcctggcatgagcagattctcagcagatgggccctcctgtaatccgctgagggctctcctgcagtgccagcagggatcctagtcattgtccccaccactcctgtctgtcttcacccagaaccttgtctggatcctgggaggaagcaaacatctcctggtgggaatgtgaggccctgccaggttgtaggagtaactggaaaagggcaggtggccctgcccactatgtgggcacctcatgataaatgatggctctcattagccctaactcctcaggcaccttcctacctggcaccattatgctgggactaccctctcactctgggagcttcacgataaacccatcttggcttaccctggacgcctgtcagctcctggcagggtgcaggccagagggataccttttgcatcatgagattgtgcaacttgggaggctgaggcgggaggcttggttgaggccaggagtgttctggcaagttcacggaaagttctggcaagtaggcaggccagcctcttgcttagacagtgctaaaaggattctttttcactatctgccagtaaggaaagtggccatcttgttcagaggacggagtgcagcatccacatacctaccagcatgaacttggtgagcagaggccacctgcatcccagagccacagggtccctggagctattggcttcttgcctggatacttccaggattcccagtttctggaagctctggttgcagtgtgccctggttctgtggcacccagcaggtctgcaagggcagccagtgggtgtgagtctggagagtgaacatccctatgagaactgactcgtgaccctgagtttatcaccaaggggcctctgcagagacaggtcctcaaattaagagccaggcaaacctgtagagagagaggctctgggggtagactgggaggagtggaggatggtcaactgtccccacgcacttcacgaggattctccacctcccatgtcccctggcatggggagtgcaagataacaaaaaaaaaaaaaaagagaaggcagtgagcaggacccactcttcctgcagcttcttcacactcttcctacagccccagctgggccacctgcaccagtctgtctgcatctggggttggggtaggtgggttctggctggtttatggagagcctgctcctccatgaggtccatatctgttatttttccgcggcatcagcataagaggtttctggttttatgtatgtattttctggctctggctcctggtctgcatttgtatgcacaagaaggcataagagagatagagcactggatttccagagacatgtgtctggcagcattcgggaaaataacattatagcctaggaatcccatcacacatatgtgcacacatgcccacatgcaggatcatggtatgttggtggtggtgcagtttgtgcccatgaaggaaattgaaaacacttgttggagagaaaacccagtcgctggcatactattcccatcacagaagaggcagagcctatgattggtgcctcactgaatcacaggaagtgttttattttatccccacatcatgatggagggccacagctgccagctatgtctatttcttatgcacaatatagaccacaagagagaataaaacaacctcaaaactacagtgtggaaaaaaacctgtcagctagaaagggggagaaggtatctccaggagccaagaaaatctcttcaaggaaaaataaaaaaagtaacccactttactttttccccaaactgacaaatttgacttgtcagatgtaagtttaacttgtggacaatccactcaagactgataatcgccatagtaactgctgtgtcacatgatcacacagaagcctagagacggggaaagtggctttccaggccacttttcttctggtaaattctgtgatgtcagcctaattagcaggagtggaatcaggaccttggttgaagtaattggcagcccttctttaaaaagaacaaaggtattttagcaccttctcttcctgtttatgggggcctgtgccaggaccaacagggctctggtgcggagtcttcctcacccttcttcctaactggccaagctccaagcagtgcctctaaatgtgattctttgtagagccatgtctggagaaaaactcgaatttatctcctgaagttttcaaaatatcagaaactggtgagagagggggccgggaatacatttcagggctatcccgtttctttttaattagtattgtacatttcaacttctttcatttccaactgcttctccctgcaaaataaaggtatcatgtctttaaagctctccgtccatgacaacattttgttcttatactagaaaatgccattcccttcccaaggcacatctcttttagttgggtttaatttgagatgcctcttgcctgctaaaaacattggtgacttgccccagcaaggaggtgacagggccacttgtccatgttggccccctccagtgggactgagtggccaccacccccagtggctgcctttcacaggaagagaactgccttcttcaccgccgggcatcggcctgtggaaatctgtgcccagacagctcaggtggcagcttatccaagtccccagcactctgctttgtctgccccaggacaattgccccattgtcttcaggctaatgaagtttctggtcaaaacacaatgatttcaaacatctcttgagcctctctgccctccatctggaacagatgagtacatcaatcccttcaaacctgcctcctccaagtgcattctgcagagttagtgtgtgggggtgcattttaatcaaccacgttggccaatgctgcctacctggagtgaccccaacccccaactaaactgtgagctgtggaaatgaacagaagccagccaaatgaggagcaaaggctatttattcagagcttgtgctagcgagggagtcagccaccatcccttgtgttttggcagaaactcagaggcaggtaggggagtgggaaagcctcaaagaagaaagaaaggaagccttcgggttgccctgagtggagggtgttggcctggggaaaatgaaggtggctataagaaatgagactcccatgtgattggttagggagcatgtttggctttctttcattggtcctaagttggaagtggggacaaaaacctagggaatcaggctgggcatggtggctcatgcctgtaatcccagcactttgggaggctgaagtgggcagatcacttgaggtcaggagtttgagaccagcctggccaacatgttgaaaccccgtctctactaaatatacaaaaagttagctgggcatggtggtgtgcacctgtaatcccagctactcaggatactgaggtggcagaatcgctcgaacccgggaggcggaggttgcagtgagctgagatcatgctgctgcactccagcctgggggacagagcaagactccatctcaaaacaaaaacaaaacaaaacaaaaaaacctaaggaatcggtcagttattaatcgagtcctagaattttggggctgattgctataggagctgttgtttggcttctgggatgattgctacagattgtgggtcagagtcctgtctttctatatggtcttgacattgtctgtatattgactctctcagtgtgtacaggctgtcttctcccagcctgcttaaaattaatgagagtttgaacagacgagtgtgtggagggcacatcatcattagtacaaatagccacagatggaaattctgcatgcctttgacagaactgagtttgagaggctctacctcaacagcttcctcagcccagctgaagtctctctccctgaaggcccatgcacctttctcagccattgctgggaattcaggattgtgtgttggaggccaacattgggtaccatgagtggaaaccatgaactggggcaagtcctcctggtacacacacccagctactttttccttcctcttctgccccatcccagggaaccctctttgtaccatcccacccactggccaaacttcagggtcttgtcttcatacttactgcttttttctaagggaaaagttattgagaaggcagtcaaggttcatttatttttaaccaggagacagtgcccccaaacaagaactgagtccctagttatggaatgtcagacacctcgcagcaggtggtggttctgaaacacccggatccagatggcagccaactccacccacatgtcaggcgggcgacagcatttccggacatattccttgtttagatgaggagattctgcccccagtaacattccttcaagcagcaaaatgatgctagatctttccagaggtcacagactgaaggcttgggggctacagtctggaatgtgttttgcttggcacacatgcattttaagttgtttaatgacctatcaagatttaaagatcaggagctgacctttcatgttaaaaagaaaatctatattttccaacttgtcttggaaaatgggatgctctggcaacacttggccatcttcccaccttcagatgctcagcagaatggcagctgccctgtggagaggaagcacctgttcccttccttgccactctccctggctggcctgcagttttctcctgtgtgtcacagttatggactgactgcttgtgtcctgccaaattcatatgttgaaatcctaacccccaaggtgatcatattaggagatgaggcctttgggaagtgatgaggtcacgagggtggagccctcatgaatgggattagcgcccttatgaaagagaccccagagagctctctcactgtctttccaccatgcatgaaaatgagatgttaaagtcttcaacctggaagagggtccctgccagaatccggccatgctgggacctgatcttggacttttgagaactgtgagaagtaattttcagttgtttacaagtcatcccatcaatggtattccactatggcagtccaaactgactaggtgactcaccttcttggcccagtgggcatttgatccagaataactcattactgtctgaggaaattcccactgtctcttttcccagaagtttttgtttctggtggcttcttgggggattccaggcacagtagggccaagcaatgggtatagagtgaccctacacctttgacttggcctcctgtggacttagatggatgggtgtgtttcctaggagccctctttcctgtcctcaacccttttcccatgagaaatgcctcttcttgcctcagaaacaaacgaaggggtcagtgtctgccaatgtctgctcagcccagagtgaatgtctgagagattcagtgtgaatgtgctggttgcctgctacagatcaggcttggcaggtggtggtaggtggttaaggttccagtttcagcatcaagtatgagttgttactgctcagagtctcagttttctcatctgtaaaatgggaagattcctagctctcaaatttataaggctccactggccgtgtgtaaaatgtggcaattagggaatactgttggctgttaactatatccaccaggacaggctggttatgctctggtaaaaaataaacccaaactcaatgtctgcgcccagcacacatttatctcttgtgcatgctatatggccatcttgactcagcagggttctattctctgtcacctttacttaggagtgttggttggaagaatcccccaaagtagtgccatcagtctctatggcaggggaaaggggacatggtgtatcaagccttgggcttgaaggtctattcccagaagagacatcattaccgcaactcacgtttcattggccaaagtgagtcacaagccaagtttaacttcaaggagcatgcccccaagcctctgattctaagtgctaccgccttaacacatttgagctcctgtaacaaaatgccataagctgggtgacttataaacaagagaaattatttctcccagttctggaggctggaaagtccaagaccaaggcactggcagatttggtgtctaatgagaacctatttcctggttaatagatggtgccttcttgctgtatcattacacggtggaaggggcaaacaaactctctggggcctcttttataagggcactgatcccattaacgacagctctgcctttatgacctaatcaccttccagagcccccacctcctaatgccctcactgggggctaggtttctccatatgaattctggggggacacaaacattcagaccatggcagcgctctcttccctcaccgcgtggctggctctccaactacaacaccatgccccatggctcacttccaaggagactttctggagaggtttgtcctaagagacagaagaatgcatcctgcctcaagttttagttgcataggttcaccctacagtgaggtaatagttacacattcttaatgaaaagatccaaaagcccaatacatcctgttctgcagcatataaagcatcttcttcagacctggtccaagactactctgggatttttgagtcagaagagagccagagcctattcagtatgctgtttgactctgatcccagcagccaccaccatgttaacaggatgagcagggctttcttcaactcagggttcctgtgaaattaaaaagaattctcatcttgactcaggattgttgaacactattgatacttcttccaaggtctcacaagagtttgcctcctctcattgccatgtgaagacctctgtgggggaacaatgcatgggttcttggggtattataggggactacagagaagtgtcacctccacccaacagcctgattcagtctactcctcaggaggaacacaaagtggtctctctagtgccatgaaaccccaaaaagtgtcaaccagtattaaaggcctgcctgatatacaaccctcgaatgcaacacagtgtccttctgaggccactctaaaggccaggaaaggtttgctaagaagtctgtgctgttaaaaacagaagaaaaagacccttatcccattgctctgtgtctggtggctatagggacagtatttcataaaaaaagaaaggcaaaaataattttcaaaaatgattcaagaaatgctgtcaaagatagcaaagaacagagtcctcagagaacagtgcccaggacaggataagcactcaataacatataacactgtgtagtgctgttgagtgctggctgttgttgagtgctagctattgttgagtgcttgttgttgagtgctagctgctgagtgctagctgttgttgagtgcttgttgttgagtgctagctgttgttgggtgcttgttgttgagtgctagctgttgttgagtgcttgttgttgagtgctagctgttgttgagtgattgttgttgagtgctagctgttgttgagtgctagctgttgttgaatgctagctgttgctgagtgcttgttgttgagtgctagctgttgttgagtgcttgtcctgcctgggccctgtttttagcctttgatgtacatttctccatttaacttccacaatagccctattaggcagctagtattattatttctgttttacagataaagattggttttagctcagagtagttctgaatcttataaaaagaaaaaaatatccccaggaactgaatcggctccaaaatagccccatcttgggctaaatatgggatgtgacaaagccaccatgaagctaggcccccctgtcctgacagctttccaccccttccctgcccctctcaccctgctttccaggggcaatgcacctccccacttctcctgggaggggtgggcatcctctcagtcccataatctgtgccaggcccacatatgaggacttgacaggattcagcagagatgcaggcctctgctctgctctgctcatctctttgcatatagtaatttaatgaggacaaaaactgcatagagctagtaatggcacgaccaagcagcagcttaagctttgagccgctaaactatgctgcctcctattgtaatacgattatattataacacaagttcaagagaccacccactgctttctttattggatcttccaataaagtggccatgctagtagcacaattccccacggaaatagataatgactattctaaaataaatccgaggacacacccagccacaaagtgggaggtgtattatacaaatgcaaccagggcctctggatctggcatttagacccacagcaacagcttgtgtttgctcagggctaagaatgcaggactcagacaccgagagcctctgagctgctgcaaactcatcaacccctccctattaaaggccattctgactaccctcagttttcctcaaagagcagttgagagctaaggtagggtagggagccaagaggaggcagggagagccagagatggcagccggcaacaggacacagaaagaaaagggacttcaaaggcagatctaataactcacagggctttttggtgcagagtctggagataatgcacagaaatgacaccttgaaaggggaaggaaaagaaggaagaacacatcatcagccccggacttcaggtggctgaaggagagaatgtatttggcatctaccatatctttgcatccttcaatgacacatttgtccatgtcactgatctttctggcaaaaaaaaaaaaaaaaaatgtgctgtgtgactggtgggatgaaggtaaagggtggccagatgaatcctctccacatgctgccacgctggccacccaggatgtggcctagaggtgcaaggaaccagacaccactggcctacatcaaactccaggccacagatggaaataggactgagatccctggacctggggcccgctcaggtatgaagatcaggtggattgaggatgtcactgccatcccctccaaaagcacctgcaggaagggggttgccatggtcaccatctgtgaacaggactcctcaaaatgttttctgttaataaattgccttcaagtaaactgaaaaaaaaaaaaaaagagggagagaattcacacaaaatgatgcccagtcttggtctgcatggtgaagggcccaggactgatgggcgggggctcatttgcataccacaacaccagggagagtcctgtcacctgccctcctgagtcctgaagaaaacccttcactccaattccctgtacactgcttctaaaggcaggaaatgtgtacagttctagaattacagtcacataaaatgctagaagaataacgtgatttatttaagtgcttagaggtacccccttgaagtttgtgttacctggaagttggcctcagggaaacacctcattgaccttctctcaaggataaatgagatgcagggacagggaagggagaaaggttattttaacatttcattcacagtccctgggattctttggagagcaccttaggaatgttcttaacctgagtcctcttactaagtattatcacatagtctgccaggctggcattattaaccctactttgcagctgaggcaactacaagagatgaccctatcgggctagtgaagtggaattcgccatgtactgcatgcagtcatgtactgcagtgaccaatccgggtctaatttctttgatgatatcattgacggggtagcaggggagaggcaagtgcaagagaagaaatggggtgaaacccactgcagggaagcttgggctggggcaggatcggggagccagggtatggggcatggttgggactgaaacccttgttaacactggctttagcaaaagaaatgggcaccacaatcccagaggacttccagaagcttcctccctcccccgcacctgggcacagagccttacctcccctgcaccctggccctgtctctctatttggcaagactcccatgtcatctgctcctctttacttcgggtccctcttggcactggaaatactaagtgaacccagcagttgcacaggattctaggaatttctcctttccaacttcctgaactggttttctaattcacctcagaggtaccttaacaaatcatgttccaaggccaggcacagtggctcacgcctgtaatcccagcactttgggaggtcgaggcaggaggacctcctgagcccaggagttcaagaccagcctgggcaacatagtgagaccgtgtctctacaaaaaataaaagaattatcctggtgtggtggtgtgtgccactacactccagcctggatgaaagtgagagatctctttcgaaaaactcacgctccacacaatcaggaggtctgccatccacagactccagacagatagttccatcagccagcaggagcggcatgggcaacgtcagtagcatgcacatcaggttagcttctctgaggtcacaaagttgcctggaagtggggaatccatgagggccaggccctccacaggaggaggacttccctctccagtcaccggcctccctgatgtggttccctcctctcagcccacatgctcctgccgaggtaacatgtccccccactctatgttagaaaaccataaagcccccaagagacgtttctaccaatcatctaaatattgagtttcaccttataaaatttataaaacgtaaagaacacttggaacagcccagttttaatgcctccagcttttgttttccaaagaacaattggtagacttggccccgaggggagcagagcccggctctcagacaacgagcctcaccagcaattctgtatcttcgaggcggcagaggtttttgtgatcttgtgtcatttctaaacacgacggtgtagatgggatcctcttcattttgcaaatgagaaaatggaaaaacccgagggacaaagggcctctctcaaggtgccatggtgagaaggaggcagaaggaagaggacctcgcccctgccttgattccactgactgctgtttatcacaccatgagtgtcttcagggagcagtcgttctcccgctggaatgtttacatgaggagcaaatgtgatgccatcacataattccagtgagggctggtcatcccctgcaaggctgaaatgaccctgtctgttttaatgctaaggaagcagcagcttttctcccactcccacacaggatgtgtgcagcatcttcaagtctctgcctcgcgtttctagatctgtagtgagctctccatggtcagggagtggatctttcagttgggtatttttctgaagcaactgtcattctttgctttttgtaacaagacatgtttttaaaatcctctgagagagaaagagtgttgccagaaaaggaatgaagagtgggagaaaggtgcattgtggagctgtctgagcgttggagtatgtcccaataacgaagagactgcggagaagcatcccctgtccccctccgtgttctaaatgtatgaaacctaacaaggtaattgcatgggaataacacactgtgaatgttatgtgggatttgaaattgtcatcccaagagtgaccaggtggagagaggaagggtgaactctttcagtctaaaagctatgttttaaaaggcagggttagactatgtttgtttctgcagtgtattttctctgcataaagggatttttttcctactttttctgctggtggacgtttcccttgggggagcctggccaatgaaaggtcacacagagaccagtcactctcaggaacaccagcagagccgggcagacacatgtcctaattttcccaggagcagactgattgaaccataggagggtctgtctgatgtttatcttggcagaattctcagatgagttagcaaatagtggctggagataaactgaaactttgagcaacctctggactgactctgattaccctccacaccctacctgcacagggaggagagaccacaaagccagcagcaaacagtaaacttttccaagaatcagagaggaaggagttcctgacaccctgcagcaaaaacaacctcaaaattcccctgaagacagacccatgggagctggggtcaaggtggccttgcgcttcaccgaggaggtgtcattaccaaacgtgctggacattggctacctacggaagaaagattaaggactgaaagaaaatagtggagaacatgcttttgacatgggggtaggacagggaaggccttgagcaagacacaaatcacaaaagcaaatagagaaagagtgatgtctaccttcaatgaaatgtgaaacttctgattcaaaatcggaaacctctataagctgagataaaagacaagcaacagagttggagaagatatttctaacatttgtatgtgtgcaaatgtatgtgtgtaatgtgcttatacatatacatatagataaatgcgtgcgtatacacatgaattctggattgttatctaggctctatgaagaattcctatctgttaataagaaaaaagaccaagatcaacaacctcatagacaagtggataaagaagatgaccagttagtccacagaaaagaaaatgcaaatggaagtgggagggcccagaggaactcttgctttatctaaattgtgttgattacgggagcatatgcttatattaattttataggtaaaaaaacagaaaaagtacctgaagattaaacctaagcaatgcgatgtgtcagttttgacaacacacaggaaggggctctcagcctgtaaaataggagcccttttgtgtgaagctgaccagatgcggagaagtttcaacagtcctagagaagaggaccgcaggggacagagagccagggaacagggcagggaggatctaagagggcacccggccaagcggttcactgcagctggtgcagggctcagctataccctggggctgggcgcttagcacagtgtggtcagatgaaggcaagcaagcagtggcagggactctccatttgagtcaaagtgacaagcagtgcccccagtccctgggaaggatgaaatccaaatttaattcccttctgaacaacattctacaatctatgcttcatttaggtatctgtaagcctaaaagagctgaaaaatcattttatttccccttccaatgtacaatttctaagacatttgaattatcgatgttgaagtttcattgagaatgagctgagtgtcctgctttcggcctgaaaacaaagcctcagccacagtcttcgtctcaccctctttctctctgtttattttcttttaaaaagtttctcccatttctttgttctttaacaaagagttgtgtgcatcttctaagctccaagtgctgcactggcttccagcagacaatggcaaccgtggccctgacctcatggcgtgactgaacggagggtctcggccaggaacgtgagggacgccagaaagaggacattggtgggcaatgaggggtcttccttgcgggggggtgttggggggtgtgctgtgcttccctagcagtccacgaccactggcaggggacaccccgggcagaccagtggtccaaatttataccagcgaaaagcaaatgctgatgccttcccaatcacggttccttcaaaggcttcagggttccttgggaagggaaaagaacattagttcagctcctgcgatgtgctgggactgtgctaggaagtttcacagatgctagttcatttagattggatatgcctcctggaccagtgtgctgtccattatggaaaatcaaaacagccattgcatttccatagtgttcacaaggagcctcatttctgggctcaggcaggctgaggcgttccagggttgagaatcagacttggtgactgagcaggaactgttgtcctttttctcttttgagatatgaaatttgcttcacatctcagaagagtgtgtgcctccatcccacacttgggacaagcgccgttattccttttttaaaacatctgtagaacatattaaatgctctgctttcttcacgggttaaatcatgctggggcgggaggcttgtggtgtaagagcggtgcactgtgcatccactagggctctcccgtcattccagttggtctccttgccacgccccagctcgctgcccccaggctgtcttggacagacacatttgtgttttgtaatagagcacatcatgcactattatatggggatattttataaaggagcccacgtgacacaaggaaactaggagaaaacaatcctagaaatccccaaagcttggaagcagggacatgcaagcgaggtacagcatatgctatcaagtggcaatgtccttccagtaggaaagccgctgttgtcatcagtttaggcaggtgctgggattaagcacatctaccactcagaaaataataccaataagaaccacggtccacatccaacatgggtctcccaaattctctaaaatgtggaagtgtgcagatcttagcatctctgtcctttctctcgcttcgaggaagttgggctcctgggcactgcctcatcagtcatgcccagtacctgtgtacaggtgcctcccctgctctctggagcatcgggactggaaggattgggaacagaacggagctttgattgatcctcttgtccgcacttgtgcctttcaactccctgtggtggagggtgacagtttagtctccctgtcttctcctggggtcccaccggctcctgaatcaaatcctgctcttcccctgcatgttctgagtggcctgtacactctgggctctctctctccttgacccctggaacaccacctctttggttcttagtaaaccggagccttcctacctggtagtagcactgacatcctcttcatccactggaagcttccagatcctggcccccacaacccattctctccccatagggcttccacagaaacacaacgtgtactgtgtgccaaatgactggcccagaggatgagtgagtgggggaccaatgtaggctaggggaggggtcagaagagaaaagttccaagagagtgggaacccaaggaaggcttcttagaggagctgggacacattggggcctgaaggaagtggacatttagacgatcataaagactgcagggatgtccaaccttttggtttcactgggccacattggaagaagaagtgtcttgagccacacgtaaaatacactaacactaatgttagctgatgaagaacaacaaaaataatagcaaaaagtctcataatgctttaagaaaatttatgaatttacgttggcccacattcaaagctgtcctgggccacatgcatcctgcgggcttgggttggacaggcttgagctaaagcaagtgtgttctgagctggagagaaggccagccccatggttcatcgttcgtggtatcaccaaccaatgatactaggaacagttggtgggtgcaggccctgggcagggcaataataagaaaaagcttagaaaagaaaaggaggaggaggaggggagttgcgggtcatggagggccttgaaagcgagactgagggtttggaccttaccttttcggcatactaccgagcaggaacccctgtcactgtaatttctgatgattctgccttccatctttgggaataacaatgacatagtcgactactcctctacaaaaagagtcgtcagattctttaaccatgtggggcatcttgttttggcatccacactagttctgttacagccaaagctgggggtgttggggaatgtcgcatgcttcaggggtatctgtgtagtgtgcattttacccagctgagctcacaactttaatgtgtgaaggtgatcctccagttcaggaggacagagttggtgcccctgcctgtaccatcctaagagaggtttctgcttcctgtgtcctgctctgtgggctccccaggtacccctgtagtttttgcctaatactttggaaccaacaataataacttatgaaatctttatttcaaacacagcttgaatttcatccattttcatcttacccaaagagatagattctctagtccgcaatctggatggtcagaatggagaaatccccttacctgcaaacacaggtcttttattttgtaaccactgtctgtctggttttctgttttggagtctcccagggtgatggtgccgccagataaaagttctaatgagagagggagggtgggagggaggttccggtggcaaggcagggcggaaggtaagcggagaccttctccaatcagaagtctagaaggcagggcacgcagtaggtctgcagaatgactcagaacccgcgtatgaatgctgtctattcatgggtccaggcttttgttaaagcctgggcctgcattttaaagagggagtcagggaactggctggactggtctgacaactaaggagtggtgaacacttcccccaggctagtactcaggtggatgaagtcatcaatattttctgggcagtcctaatctgtgattaacttttatctctgctgtgaaataacagcctccttttcagcctgctaacaataagttaacctggctgcccggctgggggatattttatgctgggctccagcagaggcacacttgagaagccatgtgggactcctgccctggagagagcccagagtagagggaggggtctgtatggtggtgggagtcctctcagcaatggtccttgtgattccggtatactctgatgtcctgacttcaaactcagcttacccaaagcaaatgtccactttcttccgtactcctttcttgtttaaagcctcaccactgaccaggaagtcttgatagagccatctagtaattcttaagtcctacctcatccaaccttgttttgactcctgcagtgagcacagctgccctcaccctcccctctctatgccctcacctttgcaggagactctcaatttctcagtccacatcagctctcagaccaccaaagcaagggttatttttctaaaagacatttgttcccattgctcctctgactaaagttcctactatgggacatttgcccttggcactcaaggaccttgcaatcaggctgagaacctcaggttctcaaactcaagaccatggggaatgtaataggtgaatcaggcaggtgaagtccaggactctttttggtttatattttgtttactcagttttgatggagacaagcataccagaaaattcacattcctcttaactctagcagtagacaaacaacagagcaagcaggatgtgaccatttatacatggcctcactgttggggaggcagtagggagtgttggagaccagggtcaggactagggctagggcaaggctaggaaggtgcccaggatgcatgttttaaggaagcactcactcttggggctttgcaagtacaaggctagcactgggagatgagtgcctccttaaagttggcttcttgggccttgtttgcctgacctagtctggccttggtgaggacagtggagaaatggagcatggacctacccaaagggatggctgctgatcagcttcacctagctgttgccaaaggcaacactgtggccccacttttgccaaatcttttcaaacattctgtgggtgcttccatcatagctattatcacctggcaagggagttgtccccacaggtaaccttctcactaagtgggggtgtctgaggccagggagagctctactcattcccctgtgtgatcccagcagtgagcatagagcaggtgccctgcaatgttaagcaaaaaaaaaaaaaaaaaaaaaaaaagactttggaaatagagttatggagccaggatgggtcttgagttagcctcactctttatttctttattcaaggaatggttgttcagggccagcggctcagccctgggagcactgactgcttcaagacacagactcctctgggatgccaggcagagtctgctcctgaaggcagactccactcttcatggggctccctccattactcattaggtcacagaataatagaaaaaggcaggaaagatgaaaaaagagaatttaagaacaaaacacgtccaggtgtggtggctcacacccgtaatcccagcactttgggaggctgaggcaggcagttcatctgaggtcaggagttcgagaccagtctggccaacatgaagaaaccctatctctactaaaaatacaaaaattagctgggcgtggtggtgggcacttgtaatcccagctactagggaggctgagcccagacaatcacttaaacccgggaggtggaggttgcagtgagctgagattgcaccactgcattccagcctgggtgacagagcaagactctgtctcaaaaaaacccaaaccccacccccccaaaacccaaaacacatggtagcaaaataataacaaattgaagtatgtctgtaatgacagcaaatgggaacttacctactccaagacagaaaatgattagattagatttctaaaaagtccaggtaggtcttgcttccaagataccatctaagatgaaatcacacaggctgaaaataaaggaatggaaaaatatacactatttaaatgctagcaatagcagacagattataataggagagagactatataataatcaaggcaccaaccgactcagaagctgtcacaggcccaaatgtatatgtatgtgtctaacatacacgcacctcaaaatatagtaagcaaattgacagaactacaagtctaagattacaacccatttaacttgatcaaaagttgataaatcaagcaatttaaaaagtactaggttataaaagatttgaaaaacaaaagtaacaagcattatctaatgggtgtgtgtgtgtaaaactttgcggccaaacataaatggtcatcatagatcatttaaaaacagttggtgatatacagattatttaaaaatttgaccacatactaggtcacaaagaactcaacaaatatctagaatcatcaaataacacagatcatattctctaaacacaacccaattaaattagaagtcaatactaaaatacagtctcaaactcatatatgtgggaactaaaaaattcactccctagtaactaataggctgaagaagaaattacaacagaaatttgaggagtttgagaccagcctgggcaacaatgcaaaaccctgtttctacaaaaaattagccaggtgtggtggtgggtgcctgtggtcccagctacttgggagactgagttgggaggactgcttgatcccaggaggtggaggttgcagtgagccattatcatgccattacactccagcctgggccacagagtgagaccttgttgaaaaaagaaagaatatctagaggtaaatttatagtctgacatgaatttatttcaaaatcatgagaggtttaagcgagctgagtgctcaaaatagcaattgtaaggaacttccttaatgtgataaaggttatctatcaaaagtgtatagtaaacattataattaatggtgaaactttggaagcatgcccatcaatatcagtaacaagacaaggatgtccattgtcaatatgtctattcatcagtatcctggaagccgtactgagggcaatgaaacaagcaaaagaaataggagtataagaatttagaatgaagcaagaatatttttatctgcaggaaatatgataatctatatagaaaattcaagagaattttctaataaactattcaaatgaaaatacagtccaacgaatatatatacacaaaattgggtacaatttatatgtattaattataaccaattagaaaatataacaggagaatgagtcttatatttcaactaaagctataagatctttctgcatacattaaacaaaatatgtgcacgttgcttggttttgatttttcttggttcatttggctggttttagaggaaacttggaaatacacctgagggacatgaaagaaaatattagtgagtggagtgattcaccacattcttaaatggaaaaactagtgttgatttaagaaagatgtcaggccgggcgcggtggctcacgcctgtaatcccagcactttgggaggccgaggcaggcggatcacaagatcaggagttcaagaccagcctggccaacatattgaaaccccgtctctattaaaaataaaaaaattagcttggcttggtggcgggcacctgtaatcccagctactcgggaggctgaggcaggagaatcgcttgaacctgggaggcggagtttgcagtgagccaagattgcgccattgcactccagcctgggtgacagtgtgagactccatctcaaaaaaaaaaaaaaaaaaaaggaaggaaagatgtcaatatcatctcctaattattctttaaattcactacaattctatccaaaatcttgaaggggatttttttgtgtgtgaaatttgacaagctgataatcatcaagactaattatacatttataatacttaacatagtacaatatcgatatatagatagtgaatagatcaatagaaaattagagaactcagaaactgacctatgcatctgtggaaatttcatatataacggaagagtcattacagattagtaaaaagaaggggtgggctcgttcaagaaataacttaggaaaaataggttatccatacaagaataataaaattagatccttatatcaacgcacatgtaaaaacaaatccttggttgattacatacctaagtgtaaaaagcaacaacttcaaataatttagaagaagatgtagaagactatctttatgaactcagagtaagaaattattttcttaaactatatacaaaaagacccttaatgcaaaaattaacagactatttggtttagtaagcaggattgtattttaaaatttttaaattattcataaaaaatgttaaatgtcaagccagaaaccagtatttgcaatgcagtcatataattgacaaaggccagaatccagaatacatgaacactggcaagtcaatggaaaaaatgaccaaaagacatgaacaagttatggatgaaggcagctcaaagggcaaatgagcatttgactagatgattacctcttagtaatcagagaaataagcaaacaaaaaagtatgccacctgtgtattagggttctccagtgaaataaaacaaataggatttacatgtatatagaaagagatttgttttaagaaattaacttccatgattatgaaagttaatatctcttccatgattatggaagctggtaagtccaaaatctgcatgctgggctggcaggctggagacccggagagaagacaatgctacagctcaagtcaaaaggccatcaggctgaagaccccaggaagagctgatgttgcaggtgaagtcccaagaacagtttgctggagaatttcctcttgttcagggagctcagccttttactctattcaggccttcaactgactggacgaagcctgcccaggctctggaaggcaatctgctttactgaaagcccaccaatttcaatgtaaatccccatcagaaacaccctcacagaaacattccggccaagttgacactcaaaatcaactacagaacctccaacacatcagactggccaaaacatttgtctgccactaccaagtgttgacacaaaaggcaaacataagaaactcatactgggctggtgaggatgtagagcatggatccagactggagaacctctcacacatgtgcacaaatattcactgcatcattatctgtagtgaaaaattgaaaaggaactgaaaaacaatcagcagaaaatagacaaattaattctgataaggttcatatgactgagtattatacagcagttaaaggagttagagcaacaggtatctgcatggataaatctaaaaacaatcatgagtttcaggaagatagatacaacaggacagatttccataaaatggaaaacttacaaaccaatactttatattacttaggaatgaatactgtaggaaaatctaaaaaacaggcttgagattaatacacagtaaatttaaggttgtggcatctctgaggagtagggaaagggaatgagatcaaggaggccttcatctgtgtctgtaatgttttatgtgtttttttctaaaggcttgaaacaaatatggcaaaatattaagatctgataaagccatgtgggcgtatgacatttgttatatttctctctatccttattcatgtgtttaaataattctccgaaagcagtttactgagagttcagcatgtctcctgagacatgctaggaagttatgtgcaggagtggagaatatgattcattggaagagttaagtgccctaaatgccagccaggctgtgaccccaggacagaagtagggtgggggggccttcttgcttgctagtgacaatctacaccaaccagcaccacaggagccccaggatgacaaggaaggacaaaacacagggggtgacagatgcaatgaacccctatgtggtacattgagtggtggagaccgggtgtaaaacacacgatcggtgcagggagaccagctatggaggctttggggaccatgataatgaccatccagtgtggctgtacttttctctagaagagggttggcctacatccactccagtggatccacattctctcccaagagactgataagagagtgaaagatttaagtcacctgtgtgggtggccctcaagacccctgcaatgaaaacccaaaggggtatcacagtgttttctggcaagaattggccattgcttaattttcttgtctgatttttcctagcaaccttgtatttgacctcgcctggcatcctgtgtggtcatgagccacagaggtggaaaaggcaacatggtagaggcaggaggaggcaggaggtggaaaagaagggttatcaggtgatgagttcagccatctcttgccctgagtttagttgtgctttgtttataaaaagtgcttttctacaaaaagtatttgatggtacaaaatattatcaatatggcttagatgggtttgagaagtaagaaaaggatcgtggtggtagcaggaaataagacagaaattttccatgggggctccaggtctgaaggcactggcaggtactgcagggtgcctcaagcaggcgtcacttgatagggtcaaaaatcagtaatgtctatgctcatctccaacctctgcagatagaggaggaaatgttgtgaagtatttagatgcattttcttaggtgcgttgtttttgttgaattaggacatgaagccagccacagccagctgtctctccccttcggtgagaaggggacgacgtgaagcacccaagatgtgaaccaggactcaattcacatttggggaacctgatagcctcctcagatgcccccacagaaatccagattgacccctgaggctgagctttaccctctgcagggatgacttccatccagcctgggatgggcaggggaaaccgctgctcacccgaagtgtatttaaggggtcccaacagcaacttatcaacattttttgttgtaaagcacagagagagcagtgaattctgtccattttgtgagcagcacatctggataaggcgggtgccccactgcattcagagcagctctgggaatgaggaaggaagagacaacaaaaggaacaggagccttccaataagcccagacattagacctgagccttgtccctgtcataggctagtcattattgattaaaaggtggacatcagataaacccaagagggacagccccgccaacgtccagagcaatgaggccctcactctgccctcacctctgccagtgtaaattctggggaatttctgaaacaccgtgaatacagaggtgtgactcagcgggaatcacaggaatgtcagaggacaaagcagttggtattaataaattgctttgagtctggaaacaaagaagtggccttctttgtttccaggctgaagtacagtgctgtgatcatagctcactgtaacctcgaactcctggcctaaaatgatcctcctgcctcagcctcccaaagcactgggaatacaggcatgagacaccatgcctggcctggccttcagtttctctgctctaactctgcgttgccctagaaatccttttctgaatttctcaggtattagacattcacccatgacatctgcatctttctcatcttcaccagaatcaccctgtcttaattccttaactcttcctgcttcttgccaggctaagaagctgtattagttatctattgctgtgtaacatgtcaccctaaaacgtggcagcttaaaacaaatgtgtgttatctcacactttctgtgagtcaggaatatggacacggcttagctgaatgcttgtaactcaaggctgctcatgaggctgcagtcaagctgtcacctgaggctttggtcttatctgaaggttgactggcatgggggcatctgtttccaagctcactcatgtggttctgtccctccccacctaggcatctccacaggctgccttgtgacatgtggctggttaccctggggtcgtgtgactctagagagagtaggacagaggacccaaaatggaagccacagtgctttttataacctatgaagatgtgacatctcattacttctgccctattctagtcatagaagcaagttacttagaatgatccacaccgacagggaaaggatgacatgagggtgaggatacagggagagtgggggtcactggggcccatcttagaggctgcctaccacagaatccctaattatttctctgaaaataaaaggaggagaaagagacaccatattctacatttctgctcacctctgtggtggggctgatgtgcatggttttcatggcttaaaagcacactccatctcactgggggtttcccaaatggtcatatgaagagaggaattgctccccagaaccgctggggcacctcatttcgttgatgctttttcttcctctccacggagatgctctgggtagaaggaatgaagccttcaaggtggactctggagggctctcccagaggcttctgtctgaaccagtgggcttaaaaatgagcaagggagaaccttcatgaaaatcactgtcaagtactgtctcagtttgctccagctgctgtaacagaataccatagactgggtggcttgtgagcaatagaaattaatttcttgcagttctggagtctgggaagtccaaattgaggtgctggcagattctgtgtctggtgagggcccacttcctggttcatagacagcctactcctcgctgtgtcctcacctgaaggaaggggcaaggcagctctttagtgtctcttttatgatagtactaatcttatttgtgagggctccactgtcatgacccgagcacctcccaaaggtcccacctccaggtatcatcccactggggatcaggcttcaacacatgaacttgaagacaaacatttggtctatagcaaacacccaccatataccaagccccgtgcttctctgggcttgggggtgctgggataccaaggtaaattaagcctgggctccatggcaagctggtgtgatggttgagagaaggtctaaggggtcagtaaggggttcttgcctggcacggtggctcatgcctgtaatcctagcactttgggaggctgaggtgggccgatcacgaggtcaggagttcgagaccaacctggccagcatggtgaaaccccatctctactaaaaatacaaaaaagtagccgggcatggtggcatgcacctgtaatcccagcactttgggaggccaaggcgggtggatcacgaggtcaggagttcgagaccagcctggccaacatagtgaaaccccgtctctactaaaaatacaaaaaagtagccaggcatggtggcacgtgcctgtaatcccagctactcgggaggctgaggcaggagaattgcttgaactcgggaggtggaggttgcagtgagccgatcatgccactgcactccagcctggatgacagaacgagactccgtctcaaaaactaaaataaaataaggggttctcatcctagtgctattctcagctgagtgactttgggagagtgacttgaccttcatgagcctcagtgttcaaaggatctttatgattatgtttgtgaagccctccgagtcacctctgagtctgagcatccatctaggtgctccatcagcagtaggtattcccagtgctattgcagagaaactctctaaacccacctctcaaactgggccagcctggagactggacccagtgggtctggatgctgacttgagcacacatgtacctcggctcctcaggaaactctcatgcaccccagtggctgggagccactggtctagagagtgagctgcatcaaggaatggtggcacgtgggaatgtgagcaggtgcaggtggacactgggccaaggtggggcgtgtctggactcagggcctcgttggccaactctcctaggacttaagaagggagaggagcccagatagaggagccagttttttttttatttccaacttttattttaggttcaaggggtaggtgtgcaggtttgttacatgagtaaattgcatatcatggggttttggtatacaaataattttgtcacccaggtaatcagcgtaatacccaataggtagtttttctgtcttcaccctcctcccatcctcccccaccaggagtccccagtgtcctctgctcccatctttatgtccatgtctactcaatgttgagcccccacttataagtaagaacatgcagtatttagttttctgttcctgcgttaatttgtttagggtaatggcctccagctctatccatgttgctgtaatggacatgatttcattcgtttctgtggctgcacagtattccatgttgtatatgcaccacattttctttatgcaatccaccatcgatgggcatctaggtctttgctattgtaaacagtgctgtgatgaatatatgcctgtgtgtgtctttatggtagaatattttgtattcctttgggcatatacccagtaaatgggattgctaggtcaaatggtagttctagtttaagttatttgagaactctccagacagctttccacagtggctgaactaacttacattctcaccagcagtgtagaagcattgaggggccagttttaaatcctagtcccttcctgatgctttattcatgctttattcctgcctcctgtcacccgtcttagggatgattcacccagtcccttgctcctggctggaaaaaccttttaaggaaaagtcgctaatctgggtacatctagacttagctttgcccgtggaaagtctcttgcttttcacagccatttgctacccaccctgcacctccccacacccctcagacttcatgcttgagtcctgtttaccaaatgatgggatcctgttttgtcacctcagtcccctctgaggggcagtcagctggctggagcaggaggctgctcaatcccacgctgcaggctcctgcacaaggtcagatgtgcaggccatcatgaagtgagtgtcgagggtggtgtcatcctgaaggttaacactgtagcggggagagcatggggttgcgtgtccctctccctccttgtgcaataactatcgtgggtaattcttttatcgtcttttagataatttttacatccacaaatcagaaaaggaatgagaatcaaacaaagtaatacatgtggaagaactcagagaacagtgtcattctatagcaacaatcaacacagagcctctgctaagtgtcaggccacattctgagcacagcggagacaggattgagcaaagccaccacagagttcacattataaaaatgaaacaaatgaatgacaagtgtcacacggggtaacaagcacgataggggagacagaatgaggagagcatgtttaacagtaagaggttcgggaaggaagccggcccagacctgagtgaaattagccatgcctgtgcccgggggaagcaggtgccagcaggaggaacaccgagcccagcctcctgaggtggagggcatggggcatggtaacaggctgcacaggagctctgctctggagcacgcgatccgggcacaaccaagagcattggtggcaccacttgaacacttgcagccagctcatgacagcatttaaagtgtctttgctgatttgttgaaaacaagatgtaaaaatcactcagtgagaaggtggtatagaccatcagcctaactccaatcctgctcgggcttcacctcccacctcccggctcacgtgccctcgcagcaaacttctcattgctcctcaatttatctccagccccagttcctctgttgaatatcttctgccccatcattgcccctgttttctaagaaccagctcaaacatcaccacctcggtggagattccctcctcctggggttcacccaggaaactccaaccaggaagcaggaggtgggattccttggatgaagaagaggtgagtgagtccccctatgatgtgagctagtgaagggttgtcatcagctcagagtcattccaaaatactcttaatacatttctgttttcattgtatctttaggaattagtggcgatgtttatgccattgcagaaaaaaaaagaatgatgctccatttcacagcttacagagctggtttcacatacacttgaatggtccagctatttctgacagctacaaaacacaggcgcacacaccaccttgccttctgggaagctgtaggagacacattacctcttgacaggataaacagccacacattagagggtaaaggcagggcaagcttcaccccagcacctcctaacctggcacaggcttgaccacatgctacttcaatgacttctttttgagatcaaacacctgcccagcaccccagtctcctgacttcttgcttggagcctgcatctcagcttcctcagcagcaatgaaaaaggaagccaaccccgacctgtagaaatagtgtatttcctcaattccaaggcacacaattgttcaaattttaattattctgaaatcaggatgtgtcttacaattagtcggtacactacatgtggggtttcttttttctttcgtttttgttcaccccctacaagctgttcttaaaacaatggtgtgtcatacaattgatgacatcttagaatcaaataaaataatagttaaaatcatggggtggcaatttaaggtccacccgtgtcagacttctcgaagtcattgtgaaactgtgttttgttctgctttgaatgtctggtggtgtgaacccagagagactggattcctagatccctgaggcctcctggccgagccaggagcatggggcagacaaagggcaaagcatggtccctaccgacttgtcaggcctgccagccctgccactggctttgtgattttcattcctgaattcatagagatggctgccagcaacgagaggtaatctcaggacacacaggcctgggctaggccttggaatattccggaagtcggtggccagagttgtatcaagccagacgggacacatatgggaatacaattacagcaaagcctgcaaggctcagtgaggggcagagggcctggccacatgaggagccagtgctgtgggcaggcctgggtctgagtgccagctgtgtgtcctgcacaaccacatctcccagagtgcattcgtcaccatccactccagatgccccttgaacaaatgaatttcacagttgcaaaaggctgaaaaatgctctgtgacctggcacccccttggggaaccacagtgcattaaaggctctgagaagtcctgcagtaaagaaacctgatgaacttttgtttaagttaatgttttccaaacttctttgatcacagaatccttttattccagtaacaccttttacaatcttaagatgtgaattttctgcagaacagccacctgggaacaggcctgtcttgtgcagaagcctgagggactgggagccaatctcatcactccctcacttgattatggaaagatgaaaacagagagtggagaaatgaagggtaagaccagggaagagattctctctggggtcccaaaacatggccctggctatggacatacttgggggtggggggatccacttgcctgctggcctcttttgggcagttggtattggttgcccgggtatccccggggcagtagctgcagcagtggcctgatgggtgtgcaagcagctagctggtgtgtccagcacggtcttggcacacctggttgttttggaaaggtcttttcttgaacaggaacttgcatactcaaaaacaacagcaaaacacaaggccacactcaccccccaagggtaagtccgtggctcctcctgcacacccaggaaagatcccgtggaaacacagcaccggaggatatgggataagagacaacagagaggagtggtgcttcctgaatttaggaaacatagctgctactttgggccctctagatacttgaaagaaaaaatgatggaaatcactaggtgagaattaagttcttggtgaccactggctgtatgcaggacaaatagtactacaaagtactacaaagaatgcaaatctgtctgctgcacccagcaacttccagttggtaaaaggctatgtccctggagaggtaataactgccactgtaagaaattcctagggtccaatcctgaatccttctctcaacagcaggattctgggaaagggaagccaggttgttcatggacattcagtggaagaattaaggcaattaaatgttaagttttgcagggctggtcgacaagagaagaagggaatcataggtaatgagcacaactaaaatgaaggcacagaagcaagacggtcaggctttgctcagagaataacttcaatgagagcagtgagcaggtgctccagggtcctgggagacagtgggaggtgggtcacagagagcaggctgaggagtttggatctgctcatagagaaatatcttaaactaacagattccacgtcaggcaaggtctcttggcttcaaggagctggcagtcaggagggagcgatctaatgctgggtgggggttgagagcatctggtggaaagagggaggatgtgggcaaagagtttttccataggtggtgtggttgtccgaggggaggccatgaacagagagaactgaggcagggagagggaagcccacaggccttggggttgggtcagaggaggtggtcaaggagggaaaggaaggagagaagacaaggagaaaggaggggaagagggaggcacctcccctctcactggtgtcaggattcagattgtgactgggctttgcatagagcaggtgggcagctgtgacccacacatgatattccacccgaagatgtgtttttctgacatgcacagtaattttcaaaagcaggaaaactttatatagatatctagatttctctagataagtggaaaggcctggccttcctggacctgcacctggcagtgccacctggagctggtcacagctgctcccacaactcctggactgggcgcttcagttggctgtagtccccacccttcctactgcctcacacccaggtgacttcactcacgtccactgacaccgtctgcctgtccccaaggacactgaagtttgcaacctaggtgcagattatgtgcacacagggctgccattcacaggagggagatggtcagtggggtaggagggcgctgaaatccagcttgcatgcatgcccatgttctctgtatgtcccagggaaggaggtcccttctgtatttgcacaaagacatcgtactggctgaaaatggccctgcccgcaaattctcccaaaggtgtgtattctccattggtcacaatgcactatgtagcccatgagaaggagaccaactccggggagctgagagtgagaggagactgcattctcagacacaattgtccagacacttcctttaaaaactacacgccaatgcccaataatgctcagccttggaaaacagtgagtgtctaatcaagccatttaaagcagggagaagattttaattggttgcaagggctggtgtaattatttacagcatacagaggttttccttttgaacctcacagcaatcaagtgcagcagcaatttttctttccctattttgcagatgaggaaatggaagcttatggaggttaagtgattggcctcaggccattgcatttaatactactaataatattaacagccatagtccatcctgggcaggcctgagcatctcacacacatttgctcatttcctcctcaccccatgagagcactgatgctactttttcctctctcccagaagaagacagaggcctagaagagtctgggcagactccaaagcccacccttctagtcccaatgtgagacacccccattaataacaccaaagggcccacacctaaaggcaaatcagtcaactaaaatccaggtctttggtctagaatctgtcactcttattcctgcataatttttaacactggactcatggtgccttgagctgaaatggttcatgcaggatatatcaaaaatctgagcattaaccagagtgtttgtaatgacaaggaatctgtgccttttctatgagacataccagctctgtgtttgactctggtcagtgtaggcgttaacttctgatctgaatcagcaagacctgggttccagccttgccctgcaacccaccagtggtgtggccttggacccatcgcctgcctgtcaaggcctcatcttcttcctctgggacaagggcacagccacagcccccgtgttatggcaacacatgggtcaggctcaggtctggcgcttggcaatcagctgatgatggcagggaggctctgcttcctgtcccaggcagaggggatggcacggcctgtgagtaatgcaggtttgagtggtgagccagttcagagcaaggctgggaggacctttgggcacagtcaggctccagggatgcaaggcgtggctccttcaacttgtctccagcacagccacacacgccaccagtgtggggagggagcccctggtcattttctgctggggagcagaatcgctgatgaagggcccagcgccagtggggaagaggcctccccaacaaccctgggcctcctgcccgctcaagccacttaaaaatccgtaccgtgcccacaaggctttccagtctccatgtctcaggaaggtccaagacagtaggtggaggtgggcacatgacagggctttctcattgcctccaaacaatgccatgtgctaggccatattttctgctcttctagaagcttctgtgtcctgggccaggtgggtgctcattgtgttccctctgtctctgggatcccctcctgctcaggatttagggggattgggtgccctgtgcccacctgccagctcccatttactcacaccaccctgcaggctggaggcttagccacttctcaggaggagcctagaaaggatattggtcgcccagctgctgaacctgccccagcatccttgagggtcttgaaaaatctattttatgctgggcacctgtaatcccagaaatttgggaggccgagacgggtggatcacctgagatcaggagttcgagactagcctggccaaaatggtgaaaccccatctctactaaaaatacaaaactagccaggcatgttggagcatgcctataatcccagctactcaagaggctgaggcaggagaattgcttgaacctgggaggcagaggttgcagtgagcgtgagccgagattgcgccgttgcactccagcccgggcaacagagcaagactccatctcaagaaaaagaaaatcttaaaaaaagaatgccactgtcatgtggaaacacctctaacaaacatgaggccagctaagctggggtgggggccaggtggcagcctctgaggaggcctctgcagtcctgggtggatggttcgggtacagcctgtgaatatgagaagctcttggccactgcacatggctcagttcccatcatcgtgcatcagacactggaagacagtagttggagctgctggacagggctgttttttctcaaccagacagtatccaggtgcctgtccctcagcagagggagaggtgccacaaccggctaccatgataaggagtcagctcagagcacctttgttggggggcctgaggagatgaggtggtatggggataggattctggaggaccctgctggaacaggtagaaggacaagaataactccccactgggactggaggagaggaaggcacatgggggcccttggcagggtggagtagggccataggtaaaaggaaagaggagaaaaggacagatactggggagagtgagagggaagggaggggaggagaagggaggcggacacctccagatctggcatggcagaagtctcctcggaaaagatgagtgcaagatgtgggaggaagagtaggacgtgagggtctccaaagtctgctcgaattttcaggtacaaatgacctcccatcagaatagccccaatctgagttctgcagaggctgagagccaactcaagggcatggagtttctgaagccagaagggaccttgataaacaagaaagcctgaggcccaaggaagttaaagtgatgtgctgaagataacccagccaaaagggggcgcagcctggatccacacacttcatggtgctctacccactacaccataaaaggagagtccaaacatggtaaagatggatggcagactggcagccagtgctgtctccatgacagcactgtcatggagattgacattgacattgacattgacattgtcatggagatttacactgtcatttacaacctggcatgctttagatggtaaagtaataaagcagaattgatgtgtctaaacaaagacctccagtaccttggaaaactgcacacctttgtttagcaattgcgttcacatttagtaattgttttctgagtaatccattcatcattcatttattcctatgtctggtattggcaatttaaaaataaacacaacagaactcccactgtataattgctaaacacaatgacagctataattgaggcactgaaggaaggtcaggggagcccaggagggcggggctgctgctgcctgctgagctgggagggttggtggcaccccttgccctgggttgccatagcagatatcataatcaattacggccgtctttcatgaggaacctggatctttcccaaggaatcagtgagaagtttcagctcacataccatctctgatttgccatccctgggatgttagctgaatcctctcattttacatggaggagactgagggccacagagttcaatgcagggcctagtttagactccagaccagctgccaagagagatgaagggctggtggagaccagccagcaagtggccatgccgcccgctgcagaccccacttcacactctcatgccacccccttgggttcactgacaaaattatgctcacaaaagcagtgctctgatttctatgagatactgtagaaaataacttgttttttctttttgtattactttttattgtatgatacatattcatttcagaaaaactagaaaatacagctaaattggaagggaaaattaaagtcactcataatctaaccactgctatttacatttataccttattggatatattttcaatatctttctaggcatttttctctctgcttatgtgcctgtggtgttatgatacatatgcataggttttcattcatggttcctggctcatcactctcatagtccttgttataatgttgggagcgttaggcctcaggagacaacgtccctctctctgagtttttcctgttctcctttctcctgcccaaggcgggactctaatccgattgtgggtcaaaagaccttcatttcagagcaggtcctgccccagcccctaaaggaagaaatgctgcacagagaggctaggaaaagtctgaacgggcaggtcttgctgggtttagattgtgttctttttgcccaatcacatttctacatggttgtcagtcatgccatgtaatgaaggctccataaaaacccaagacgggccaggtatgttggctcacaccagtaatcccggcactttgggaggccaaggtgggtggatcactttagcccaggagttcaagaccaacctgggcaacatggcaaaaccccatctccaccaaaagaaatacaaaaattagctgggcatgatggcttgtgcctgtggtcccagctgctcaggaggatcgcttgaacctgggaggtgggggttgcagtgagctgagattgtgccactgcactccagcctgagtgacagagcaagagagagagagagaaataaagaaagaaagagagaaagagaaagagaaagaaaaggaaaggaaaataaaaggaaagaaaggacaggaaaagaaaggaggaaggaaagaaagaaggaaagaaaagaaaaagaaagagaaaggaaaagaaaaaagaaaaggaaacgaaaggaagggaaaaggaaagaagaaggaaagaggaaggaaggaaggaaggcaggaaggaagggagagaaaacccaagaggacagtgttcagagagctgagcacgtggagacagactggaaggtggagtagtcatccatgtgccgagtgggtggctgccccagctccacgaggaccagactcttccagaccttgccctgtgtatctcttcatctggctgtttatttgtatcctttaaaatatctttctaacaaacctataattgttaagtgtttacccaagttctgtgagctactctagcaaatggaatccaaagagggggtcttgggaaccccagcttgaagtgggtcagtcagaagttccaaagacctggacttgagactggtggaaagtgggaggcagtcttgtgggactgagctcttaagttgtgggatctgatgctatctcctggtaggcagtgatggaagggaattggaggacacccagctggtgtccactgcttggtgtgtggggaaaatccccacacatttggtcacagaagccttcttctgttgttgattgctgttgcagtgtgagagcagaggaaaaacatgatttgagaggtttttccaaaatggttcctgagtggtaatcacagtaatccatccaccttgtgagtgtgcatgcatgcttatgtatgtgtatatgggattacataaatatggctcacatgtgtatgatcgtatttgcacactcccttgtccacttacttatatatcaaagtttccctcataatgtctgttctgtgtcactatgtaccctcccctgtcctccattccccacaccaagagtattatgagtattaaatgccacgtgggcaggttccccaggcaatgagggggtgggcctgtcaaatgcaggccatgcagaatgccacagggcgggagacgggtgagccaagggagccgagagttccagataacagagtgcacagcaaatgccatggcccgcgtccagcaaccaggagaaacagaactgctgagctcagaataggccaaggccgtgtctgctagcagggagcaagggcacagcctgctgtctggcctcttctgccccatccctccactgggacatggcccagatgagaaagagctgccagacggcaagtcaagtgtggggcgggagaggacaacgttttatgcaagagtggattctcggagcctctgcactctccatcagggctgctggcatggaaaacacagagaaaccatcacctaggacttgattgaactactggacttcccagaagagtccaatttaaagcaaagaggtccagagaaaaaagcattctagtgacatttttatatatttaaaaactggaaaaaagaaaaaataattagaacactgagttcccactgtctatgaaaaatgggcccagccccactgacaaccaacacgcctcacctcacaccttcccctccgccttcgttctggccgtgagccctgagccgaccatgcacatcttaccacctggagaacctcaaactctcctcttgcccacccccaccaagccccacattcaaaaggcttgcctgagaggcctgcccacttccttggcagttctggcctccagtgccctggcaggtgagtgacttctctgtcctgtgtagcatttggtacaggtatgtactgcatttataacacttaccatactggcttggggttgtgacacatcttcaagggagtccctggagagcagaaagcttgtcctattcatgttttgcccatcttgttcctgaataatacctgcacattgcaagggatcagcaatatttccaaccaaaccataaacttctccatctccccttgaagtcttctcgataactttcccagaaactcccagaaacaacaatggctgtcactcactgagaccctcctatgcgttaggccctaggccctgtgccaagccttggcattcacgtgtcacttaaacttcaggtagattgtcagatttagcaaaaacaataataaataataatttaggatatccagttagatttgaatctcagataagcaacaaataatattttagtataagtatgtcccatacaacttttataccaggcatcctatattttatctggaaatcctggccccagggcaaccctacgtgagaaacttgtaggtccattttacatgtgaaggaactgaggctcggagaggttaaacaactttcccacggtaacacctgagatggaatggcaggcagctgacttcagagtcccccaacacggcctttgcttgtctgggagagggagctccaggtggaactggtaaagggggtgaatccattggctgggagatgtcatgagtttgagactatattgggagcacccggcacatggtggccatcaagcaatttttagtctctctctcccttccttcccttgcgccaaattggaaattcccttgagaccctcacacggagtcctctacaaacacattgaatttcagccctcataggaaagcagaaggaagaaggatgatgttgcagaagatcgctgccatttgatttattacaacagtctgaggcctcagagagcgcagagcaaagagaccctggaatgcagccccagatccctggaagagactttacaggtgtcacgttggagagtggagagtgagggggatggtctcaaagaacaggagcagagattatcagagacaccacaaacttgaaaagtcaggatgggtaggacttgaggagaaaaaaaaatcttacctttacaatagcttcaaggaccacaaatttaagggctctccagaggctttaggacagagtcaaggaagtgcttcctggtcgaccctttcaacaaaaactgtgcccctggtctcactgctgcaggcagtgatggtggtgtcaacatctgctcttctcgggctccctccacgcctctgaaaacatggaagtgcttttacccatccagaaagaggggcagctgaaggaaggaggaaagggggtggtccagcgcaggcgcagcctgttgggaaccttctgctctgtctgagcatttgtgatggttgaatgggctggcacgggcgtctaaggcaaggaactgcaagggaggctgcagcctgccctcgtgacccagcactcgtcagatggccggagtgggaatgcgtcagagatttgcctttggacagaactgaaaggatatgaagcagggatgagagaagttctttccataaaaatctgaaaaccaaagggccaaactgatcaacttgcagaacgggaaggactgacaaaaatctcaggaaatcaccaaggtcacaggggaagatcatgaggaaaatgtatgtgaggctcccagcccagccctgccaccacacagtgttggccctgactgccactcacctgggtgccccctggactgcaagcacctggcaggggctgggctttattcctgaaacagtagggggtcctatagcacagcaccaggagaatatatagcaatggatgtccaccccatcctgcaaagtcctgctcaagggccagcccccacatccccagctagaagccgcctctccttctgcaacgttctactgcggctctccacctctcttgggactggaagtgagaagcatttttcacggtggttcacaaggtctcagtgcagatggaaaacagagagtaggtgagttggagagggtggcacagactgaaccccagacaagaaggctgcctggggactcagccctggtctgttagcagttacgggtacccagagcaggaaagcaatgcagaagggtcactttaccccaggccccacctggagcccagctggggctgtccacctgcttcttcatttgtctttcctcccagatccacatcctcgcctcacatcaggaaggcccagtgctcacttttacccaccatccgcctcctcccagttgggcgagtagccctggctgctgcacagggtgcctcccgtatgccaggcactctgctggctgcagggcagcttaacctgcagggcggtcaggacagacagaatctttgctttttcttttcatctgatcagggacttctgtctgatcagaattaggtgtctgggctgtcccaggcaatgcacgacagtcactgggctctcctctcgaagattaaccctttccagatggccacaatggtggcggcagccaagcgcccacctccacataagtcttccctcttctgtccaagccaaatccactcacaggaaaggatctggaactacatggagctaaggagtaataactagagacagttcactaggatctcgtgtggagcaggaaatcaaagttggggactgcatcacactgctgcaatccctattaaacatttgttgttcaaagttctttctcaatggcctgctggaattttttttcattcttcctctttggcctgtcttccagcagtagcaccagcctccccagcttctcccgtctcctcctggacttcctcatagctgtaggcttccatgttctcaactctattattcagaggagttcagctcagtcacgtctgcgccagagctttgatgacccacctgtcagccacactaagggccctgccatgaataaggcctccgtcactgaggatcctgtacccctctgccataaactcagtgacctgactgccagccaccaggcagaacctactagacttctctaaaatagataccgtggcctccttcctcaatcatagtcaaggtctaagcttccttatcaaaggcaggcagtcctgggttttacggcaagaagtgtgcttcctatgtgcaaggtgctgtggggaagggctgagtgtggaggccatgtgtgcaggtctttaggattttagctgagctgccttttcttgcagtttaagaaaaaaacagccagccgttccctccttgtaataaatgcctctgcatatttgaagacagtagttaggtcattcttgagctttctcatcttcaaactaaacaacagtggcccctgtaacctttccttggcaaattgtaaggcccatatgcagaggaaaagcaaaacaaaaccatctgatggggaaggcctcctatctctaaccaagtgtctgttttgaaatgcggtctgcactcagtctttaattacatgtaaattcagtagcttcaagtgtctgagccagtgggagaccaggtgctgctcatcaggccccttggatatgttcatgctgcaaggctgggtgatagcacttggcagacgctaggatttcttctcttcagattcattttggggcaggaaaaggggcttccgtgagtgacccaggagcagtcagctgacacttcctccccaggttccctgagggtaggatgggccccaagagcctccagagagcctgtggcctgctggaaaggctgccctctgcctccacagaagccagcaagagtggcttccagatgtccctggtggaggctggcagcctcatcctgcagccagcgtctcccaggggaggcttcctgctgctgctaactcagagacaggggatctgctaagcgcctgccctcggtgggggtgttctgatcacatcaacttctttcccatggttctttccaggctcctttcccacatttgcagtgtgttatcttgggagaccccatgtgttagtctgtttgtgttgctgggaatacctgaatctgggtaattcttttttttttttttttttttttttttttttttttttttagacggagtctcgctctgtcacccaggctggagtgcagtggtgccatcttggctcactgcaagcgccaactcccgggttcacaccattctcctgcctcagcctcctgagtagctgggactacaggtgcccgccactacgccaggctaatttgagtctgtgtaattcttaaagaaaagaggtttatttggctcatagttctgtaggctatagaagaagcatggtgctgggcacagtggctcatgcttgtaatcccagcactttgggaagctaaggtgggtggataacgaggccagtagttcaagaccaacctggccaagatgacgaaacgccatctctactaaaaatacaaaaaattagctgggcttggcggcaggcacctgtaatcccagctactcgggaggctgaggcagagaattgcttgaacccagaaggtggagcttgcagtgagccaggatcgtgccactgcactccagcctgggcaacagagcgagactccataaaaaaaaaaaaaaaaaaaaaaaagaagaagaagaagaagcatggccaccggcatctgcttctggtaaggactcaggaagatttcactcatgaccagtcatggtcaaaggggagcaggcatgttacatgtgagagagagagcaacagagagaaggatggaggtgccagattaaaaaaatccaatcttgcagaaataagtagagcaagactccgtaccgtggggacggcaccaggcccctcatgagggatcctcctccatgacccaaacacctcccactagggcccacctccaggacccactggagatcccatttcaatatgagatttggggtgaatgaacatccaaactgtatcatccaaggtcagtgcgtttctctgtcctccagttttgcctgccatgagcagctttcctgtgagccagctgtccttttcgtctccagggtcattttcttccttcagtgcccagtgtttggactttaggctgaccttcaggattgtggagtcacagaacaagctcatataagtgtgtaagcaggcagcaaattttttaaaataaagaaaaagttatttagactgtgccagtcagtctgtgtgccatcctagctacaacccagggtggatgctgagtggagggtagaggagtgcatccctcactcttatctgtgcttgtccttcttgcatactgctgaggccaggagcacctagatttgccccagtgggactcacctttttatttatttttatttttatttttatttttatttttatttgagatggagtctcactctgtcacccaggctggagtgcagtggtgcgatcttggctcactgcaacctccacctcccgggttcaagcaattctcctggctcagccccctgagtagctgagattacaggcgtgcatcaccacgcccagctaatttttgtatttttagtagagacggggtttcaccatgttggtcaggctggtctcgaactcctgacctcgtgatccacccacctcggcctcccaaagtgctgggattacaggcatgagccgccatgcctgacctggactcacctttgaggagacacggttttggccaaaatagctgttaagtacaagtgttcaactggtgcccaaccaaagggaaagcaatcttttccaacagtgaagaagaaattggttgtgtctgcttttcaacagcaagggggtgagtctcaaatatggtgcctccattaaggtgttcaataatttcaactacatgaaaaatgtgccttgggaatgacttcagaacttaaccctccagggagaaatgcctctactgtatggcccctggcctggtctcagattggatcataagctccctcattcttgtatccccatgcccaaaactgtgcctggcacttaagggcccataatacatatttttggctttgttgaatagtttaactcattagtgatgcaaagtcccaactgcatatttagagatatttatgtgtgcactacattatggatcgtatgggtgagaagtaggaactcaaagagaataaatcatactttccctccccaaaatgtttataaagccaccaagaagacaggacatagacacatcaaatataaataaaatacaaaaggatgcaccctgacatgccaaatatgtgttcacagaaacaaagttcctcttgccaaattcctgttgtctaaagcagtttttcctaaaacatattcttcagaataccagtttctcagagtgccaatgtgaggaaaagctttggtggtcagatgagtgcagggctgggttaggctgatttctttaccagagggcttcctgaagacttaaagaaatctgtattgagatataatttgtatagcataaagttcacccactttaagtaaacaactcattggcttttagtatagagttgtgtatccatcaccacaatgtcactgcagaatgtttccatcaccacccaaaacacctcatgctgtttgcagccatttcccatccacttccttcctagcccctgacaaccactaatttaccttctgcctctatagatttgcctattctggacatttcatacagatggactcatttactgtgtgatcttttgcgaccagcttctttcatttaacttaatgttttcaaggttcatccacattgttgcatgtatgcactgatggacatttgggttgtttccactttttggctatcataaataacgtcattataaacattcatgagcaagttgtatttgaccatatgttttcagttctcttgggtctatacagaggagtggaattgctgggtcatatggtaattctacattgagcttttagaggaactcccagactcttttccaaagcaggtgcactattttgcattcccaccagcagtgtacacgagttccagtttccctacattctcaccaacacttattattgtctgtccttttttattatagccatcccagtgggtatgaagtaggtatgaagtagtacctaattgtgattgtgattttgatttttgtttccctaatgactagttgttttgagcatttttcatgggttcagggcctttgatatgttgattttttcacaaatcttcaaaaggggacacagtcggcagcagttcctaaatgcgttggaccatggagccaaacttgcaaaagcagctcctggaatgcaagcgcgtacccaaaagctgggaaacattggctggaaaccagcctgtgctggaaatgtgagtttggtgaatgtccttaggtcattacttctgcaaattttgctcaaagaaagggaatctgaactctccacttttgtacattaagataataataataataataattttatcccaagatatggcaccctggcatgatgaatattttgaattaaaggcccttggagacaagcagatgctggaaaaggcttttggttatctgtataaagattggacccaccaaggacagcaattgctttccatctgttccctgaaatctcgtacctggatggaccttttcacaagataatgtctgtttctcaggctcattaaaattcaaaagagaataattaacaggttagtttctgtcccccctcccccaccatctattcattctcactaatactcatttgttgcccctaacaagaattacctacattccccacctcctctctttcctatgaggccttgctgaaggtcaccactgtgcctttacactcaccccccttcctttccctactgcttacctgccccacaagccagtcatggcctctcctctgagccctgtgagaattcttagaggttttatcctcagtataattcaaatgtgttcccttctccaatacccaaaaacatggtatgggattattttttcagtaaggagacaaatagaaaggaggccattcaggtcttctatattttaagaccacaatcttgactgaacctataggtgacccagtgtgcataagctgctatttcctgtcctcctagtcatctttgtgtagaatcaaagacacccacctccttggtacctctcatttgtcacttttcaacacttcctggcaggcaggcagcataactggtcctgctgggtgatccagaccacactctgcaactctttcttctgagccaggctcccctactgtcttttcatttatgtcaaggcaggggaagacctcaaagggctcttgcatcccagtcccacttcccagagaggcacgaggccctccaggatgtggggacaggaactttggggcaagccggggttgtccagaagatcaccaggagggctaaatagtagaaaggagagtcttattggtgatatgtttgcaaactgggaaaagatagcctccagtgtggagcaaagatgctccctcttcaaagagggcaagggcagcttggattttgtgccttacagggtcggtattatataatagagtcatgcatattcagtaggtttggggggaaagctatatatatttatgaggggagccaactacatgggcaatggataaacatacatgtaacacatcccatgttcacttaggggcaggattttagcattaaaatgaggtggaatttggctctttacatcaaaaggtgagctatcagacacaaaggcagtttgtgcacaagctctccaaagggacttgagggctacagctgctcatctggaaagaatccttgtaagaccagtcctctgtccaaccagagttaggaggcgtctgacaatttgcctgattagctctactgttgggagtttaacaagggtgtggtttttcttgtaaccataggaatttagggagttgccacgccagccaagccctaaaccctgggcttataggtaactttttccctaaccttaagatctgtcttagttggtaaaggggtgtctattttggtctctcagatcacactagaaacctctcaagtcctgtattcttattataaagctgattataaagctttacaatttactttgtgattactgtagcttatcgtaaagcaactgtaatcagtaggattggtgtcaagatgggtacacagatgggtagaaaagaattgagaatccagaaatagactcatatttacatggtcaatttatttttgacaaaggcaccaaagaaatttagcatagaaagtataatcttcatcaaatgatgctggaaaaattgagtaactatatgcaaaaaagaaagaaaagaaagaaaaaagtgaaaacctccacctccgtcattacttcataccatataaaaaattaactcagaatagatcatagacataaatgtaatagctaaaactataaaactcctaaaagaaaacaggagaaaatagagaaaaccttggtgatcttggttttggcagtgatctgttaaattcaatagataaaacacaaattagaaataaggtattgactgaacctcataaaaataaaacataaacttttgttcttcaaaagacatttaggaaaatgaaaaggaaagccccagactgaggtaaaatatttgcaaaacatatatataataaaggttttgtatccagaatgtataaagaagttaagaagaaaagcaacatactttttttttagttgacaaaagatctgaaaaagacatctcaccaagtcgtttgtaggactggcaaataagtaaacaagaagaggcccaacacctttagtcattagagaaatgaaaactacaaccacagtgagataataacacccactagaatggatgaaattgaaaagtctgaccatatcaagtgtttgcaaggatgtggaaccaacaggaactccattcacagctagtgggaatggaaaatggtttgaccatgctgaagagcattttgttgtttttttaaaagttaaaaatatatctaccatatgactcagtcattccacacttggttatttacaccccacaaaaaatgaaagcatatattcacacaaaggcttttaaacaagtgttcataatagctttatttgtaattgccaaaaaccgaaaatcacccagttgtaccccagcaggtgaatggataaaccaattgtgacgtagtcatataatggaatgctaaccaataatttaaaaaaggaacaattgatacctataacagcattattgaatccaatagaatgatgctgaataaaagaacatggacaaagaaagagcacatactatatgattttagttacataaaattctaggaagtgtactaatctatagtaacagcaagcagatcagtatttgcctattgggggaaggagtcggacagcagcaggggaagggttaaagtcacattttagttttaaaatattcagcatgtattttgggctacaaaatagcacaaggaaactcttgggtgtgatggacatgttcattatttaattgttatgatagtttcagagacataaacataaaaaacttctcaaatacacacttccattatgtacaatttattatgtggccattatacttcaataaaactgtcacggaagaacgacccttatcttctggaggtacatgctgaatgtcttacaaataaaattatctaagaactgaaattggcttcaaggtaaagcaggaatggggtgagaagtgtgtgtgacgtggacacaagggtgatatagaagattggcatcaagtgacagaagtagacggtagattcatttttatatatgtttgaaatactacattacaaaatgccagtagaaaatctgagtctaaccctaagaatgcagtacatcctgctgccatgtttctttctttagagctgaggagaggcctctttactttggtcggaaacctcattaggtttgatttagttcaataaaaatgtgtataggtgaaatagtccatacgaattcattacaattgatgtgaaacaaaattaattaataattaatccatgcaagtcttttggtagcctgcattttatcaaagaagggacccatggcaaaggctgggaagggacctttaacaggggagcatgagttccacggcagagttgccctcaagtaatgctttgtagattggtacagcacatgtgcatcaaagtagtgaaaggattatgaaatgtgaataaggagttagaaggtggaccttgaagtcctcctgggtacccatttccccaagagtgagcatcattattcttcattcccatacttctacaggatcaatgttgcagccacagtaggtggaaaattccaactctgctaacagttgggagcgtgtccctctaatgagaggacctgttcatgcaattttcttgatgtctggtgaacgctcccacattatatcttcaaaagactttactacctgagagggtttcatgctaactgctgagtaaaaccacccagtgctgagcacgcagagaagggagtggggatacaggtccaccacagcccaggctttggagtctgccaaagcagtcagacaacggtggtcagaaaaggtgtatgagtcactcgactgactacttaaatccaaaggaatttgtttacatggaccaatcgttttagtaagatggtttgttatgtgcctttataatttaacatattaattttatttagacaatattggaaaagataatgcaatccggtgatctcagcaaaattctctcctctataaaaataatgagaaaagtgacaaaaataatcagaatcaactttttagaactctggaaatttaccaaagtgttgcagccatccaaggattgtttgctcaagcaaaacaactgaatttcacctagaatagtgaggtttgtgacattttaacttgccccattcgcatcaccctttctccagcttcatggcagcctcgaaaaccagcagcccccagtcacagagaaaacccgtctagtggttctctgaaagaccccacttgcaaggctgtctttatttaatctgacttggagtttgcccagtgtgaaaagccatttcttcaggggcatttgttaaaaacatttagaggcaattgtttaacttcacagatgcttgagatagtggataatagttgcaacaaacaataggctaattaaaaagcttaaagtgaaaactggagaatggatgttcataggggctttgaaaagctctgacatattctgggaaatctggaaggccatgagcaggagtaagataggctttgcacatgcacagagctgtgtgcaggcttggaaaagatcttagaaggtcctaaaccctcgtcaatggctcccttaaagttctggacaagaagatattgtcaaaatctaagtttaaggtggaattgtcaactgcttggatgagtgtggaagacattccccaacatgcatgtagagcacctcagcaaaaacttggagatgtaaaccaaaaagaaaaatctaaggtcgtcctaccccaaccatctgaatggaaccctcctctctgtcaagggcattccaaagtttacctgaaaaagaagttcaggccatgatgggaaggcagagctggacaaacctggtaataccctcctcctttctggagttactaacagaacagactctaaatctgataagaaacatttacaatctagtctgtctgaagcctgctacctggaggcttcatttgcatgacaaaatcttggtttccacaacctcttatcataacccagatattcctttctattgatagtaactctttcaaccaattaccaatcagaaaacctttgaatccgcctatgatatggaaacccccacttccacttgtcccaccttcctggactgaaccaatatacatcttccatgtattgattgatgccttatgtctccctaaaatatgtcacaccaagttgttacccaaccactttgggcccatgttctcaggatctcctaaatgctgtgtcatgggccattggccactcatatttggctcagaataaatctcttcaaatattttacatagtataactctttttcattgacagagacttactagttcctgatccttaaagaaatttctctccaatcattagatgaccattaaactaacaaagcagagacgtcagtggctacacaagacaaagaatacagacttataacacaattacatcagaaaagttactaaaaaacaaaaacaccaacaaactgtaaaaacaacataacctgaggagtagagaaagaatctgattttttaaagttgccacattgcatttttaatgtccagttttaacagaaaattacaagacatgtaaggaaacaagaaaatatgtctcatacacaggacaaaatcgattaatagaaactgttccagaggaagcccagacataaaacttattagaaaaagtctttaaatttagttcaaagggttaaagaaaaccatatctaaataactaaaggaaaggatgaaaatggtgtttatctaacacagaatatcagtaaagagatagaaatgataaaaaaaaaaaagaatcaaataggaatgctagagttaaaaagataactaaaaggaaaattttaagaggagctcaacagcagatttgatcaggtggaagatataatcagcaatcttgaacattgttcatttgagattttccagactgagaaacagaaagaaaaaaaaattatgaagaaaaatgaacagaacctcagaaacctgtagatctctatgcttgtttttctcaggtttgtcaaagatcagatagttgtaggtaagcggcgttatttctgagggctctgttctgttccattgatctatatctctgttttggtaccagtaccatgctgttttggttactgtagccttgtagtgtagtttgaagtcagatagtgtgatgcctccagctttgttcttttggcttaggattgacttggcgatgcaggctcttttttggttccatatgaactttaaagtagttttttccaattctgtgaagaaagtcattggtagcttgacggggatggcattgaatctgtaaattaccttaggcagtatggccattttcacgatattgattcttccaacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgctcttggtgtataggaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgcaagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctgggagaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacactttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcgaaggacatgaacagacacttctcaaaagaagacacttatgcagccaaaaaacacatgaaaaaatgctcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttttcaaaaaaaaaaaaattttgtctctaaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttctgaatcctttaagttgatcagttgacaggaatgcatttatgatttttatcttttcttttggggttacttttcagtttgactttgaaggatcactttcccctgtcattgcgcccaaaaaagccttccgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattcctttttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggttttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttcttttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccactgcacccggcccagttttttcttttatggttagttctttctgtatctagtccaagaatttttaatttagaataacacactgtattaagccttataaaaacaccagtaaattccaagacctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaattgtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtaaatttgtttgtaggttagaaactgccaggaagtcctgagatgactgtcttttccatgatatcatatagggaccttgtaaatacgtttctgaaatctgccttctctgaaaactatggcatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgccttacttacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatttttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgcttttttttttttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccatgcctggctaatttttctgtatttttattagagacgaggtttaatcgtgttacataggatggtcttgatctcctgacctcatgatccacccacctcggcctcccaaagtgctgggattacggcgtgagccactgcgccaggccgccaaggatgcttttaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttgggacccagttgttggaacagagctgaatcctggatgtttcttttgtttttttcacctttagggttagggcaaaatttttggttagattcttcttcttcttctttttttttttttttttttttgagacagggtctcactctgtcacccagatgggagtgcagtggtacgatcttggctcactgcatcctctgccttccaggctcaagcgattctcctgcctcagcctcccaagtgcctgggattgcctgggcttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtactgtggcagaaaacatgaagcattttggagaatatggaaaaacgttattccttttttttttttttttttttgagacacagtctcgctctgtctcttaggcatgatcttggctcactgcaacctccacctcctgggttcaagtgattcttctgcctcagtctcccaagtaggtgggactacgggtgcgcaccaccaggcccagctaattttttttcgtatttttagtagagacggggtttcaccatattggccaggctgttctttaactcctgacctcatgatccacctgcttgggcctcccaaagtactggggttacaggcgtgagccactgcacccggctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttcttctgtgtatagttctgtgaatttcagtacgtgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgtcatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttctggtttctaccttgtcttgtctcgtcattctcttaatacatcaaagagcaaaagtgtttaattttgatgaagctagtttatctgtatttttctttaatggatgttgcttttagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctggttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcctgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtctttgccccctgcccttctttttctttactctacgttttgctctgcttcatggtgagaagtgcttcagagtccccccatggctccaaaacagacatacagaatgatgattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagactttttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtaacatgtatcaaaattacattgttttaaaggcagtattctatatagtattccattgtatggatataccacaatttatcatttcacctgatgatgggcatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttacttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatgtggagcaaccgaaactctcatacattactggtgggactgcaaaagtggcacagcactttggaaaactgtttggcagtttcttgtgaagttaaacatacacttatataagacaaattccaactccttggtatttacttaagagaaatgaaaacatatgcctacataaagacccgcatgtatgtgaatgtctttggggccaggcgcggtggcataatctcagcactttgggaggccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcaacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagatgtgaatgaatctcaaagacttatgctaagttaaagaagtagcacaaaaaagactacgtatcatatgattcatttacatgatattgtaggatagacaaaactgtagagcaagaaaacagatgaattgtttccagtgctgggtgtaggaggaaaggattgactacaaaaggaacgagggagctttttggtatgatgaaagtatactatattgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcaagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcagtttctgatgaatcctcacagtatttaaccagaataactgtaggtaagttggtgcaatgttgcctctggaatcaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatgcatatgcaggttctgcagggccaattgcaggacttgagcatgcacggatttgggtacacatggggtgtcctaaccagtcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagaggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctcctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaattaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaagatgaggatattatatgggatgtatgttaaaaagtaaagttttaatgaatattaaaagatgtttttgaagtcttatctaaagtatgttctaaatgaagtttctgacaggttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctcttttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcatgaacccgggaggaggagcttgcagtgagccgagattacaccactgcagtccatcctgggtgacagagcaagactccatctcaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtactaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccactttgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtcccgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaacattaatctgtatttgaatgtgattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaaatagtgaaaactggctgggtgtggtggcgcatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaaaacaaaaaaaagcttaataatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagattttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatctcggctcactgcaacctctgcctcccgcattcaagtgattctccagcctcagcctccccagtagctgggactacaggtgtgcaccactgcgtctggctagctaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccatgcctgctttggaaaacatattttctctgtgctagtatagtcatggcacatcagcctatatatcctcatgttcagcaagtgcacgttaactgcttttgaaattattattataataaatctgttactcaggtgctctcatcagatgttccttcaggtacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaactttaacaaaccacgtgtgttagcaaaatgtctttggcttttgaggacataattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccttgatacattataagactcacgtgcctatgacattccagagctattctcttgggacacttctgttttaaaattctctcctgttcttttatctgcttgtctctatcatctatcattcatctgtcactgttttctagttctctttactttttttatggtactgttttgaggggaaccatcacccacacttagccacaggctgctgaagatctgaattagttgtgatttccctattaactgtttcctctccacatgtacccagttattagtcacctgtgaataaaaagatggagtgacagaagttgagtttagagcataggatttatgagcatggcctctagagccaggcatggccatgctgtgctgggtgactttggttaaattactttacctcttgttgcctcagtttcttcatttgtaaaagtaggcatacttcatgggatggtgctgtgtatcaagtgaattatttttacatagcacttagaatactgctcaatacatagtaaagctcagtgcagtcagccattattattagtagagttcattgattctaagatgcaagttttttcactttttaatatctctgaaatcagttgtgtattttagtgaacaggcgtcatagtttaattggcagtgctttttctttcttagtttctcatgaaataatgatacatcttatcagtggcatcttatattcaggggatataatattgttctcattataattttgttacttgcgcaaagttgaagtgaattatgtgtaagatttcctctaaaaaaattctatgggttgcaacagactcttggctttgaattttcctgatcccaaattaatgttgcggttgtgttcccagagaatctttaagacagcaaaatttttctttccagttagctagaaaagcagttatgtgtgtccagttaaggagggagtatgcttatgaatagctttgtctgcagagaaaatgtttgtcagttgtcagcctctgaagggatatttctgtgtcttcagatatagcttgtataggtgtttcttagttataaatgccctacttccaaaatttctgttagttttttttaagtggctatatggaatgttaagctattttaacataggaagaagttgaagagtggtgtatgaatttcacagtagagccaacagaaaccattttaaccttgaacatacctgatacataatggtattagtcctataaatctagccatcatgtaagtgaaaccaatctgtatttcccttggagacaccatgaaatccattcacctctaacacaaggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttttttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttatacagtacaccttcttttgaaatacttacagatgatatttcaattgctctttgctttaaacattttcacatgttggtttttactttaattacagattgctccaattgtgtcagcgaactatggctcttcctgtaggacgaggaatgtttaccttgttttcgtaccatcctgttccaacagagccattgcctattcctaaattgaatctgactggtatgttaaattctgggctcaatgagaaaggaaaatgattaagtacatgcattaagtgtagttctttaaattagttaaaacaaaagaaatgctccctctatccccagtgatttaaaattttcctaatagctgctgtagtggttatcaaagctcaaatgccatgtgaaactaaactttgagagaagcagaatatagttcattactcatttttgctttttaatgaggtgatttcaagatctaaaaagtcacttggagaagttcagaaagatattattgataacgatgagacttgaattttaaataatcttaagtttaatatgtaaaaatatttagttttaaaatgtcttacgtcatagtttaaacagatgatcattgtataaatcaagaaatgtactaagcaaaaagagaaacaatggtcacttgcagtactcccactcttctgcatcactccttttaacattttagtatatatgtttactaagtttatttccacatatttataattttatatttgtttaattatcagaaaatttatatctattttagatttttttaaaaatttacagtgaacatccttttatatctagcaaataaatgtatgtgtttataattatgtgtatgtattgtatacatgtgtttttaatcaatacactcatttttatttgcttcagagtatttcattcagcggatataccatagtttatagaagcagcctggtattgttggaaattacagttttttggtattataaacattgttggggcgtattcgtcctgtgtatttaggctaaatgcttagaagtagaactcttaggacagcaagatgaatggttttaaggaacatgtcaaattgcctttctggctggcacaagtttttatttctgccatatataactgtagttatagtcttgattacaatgaattttatagtgcatgtccccctaatgctgatttgaatgtgttctaaaggtgacaattacatagttgaaattatcactgaaactctattatagtatatatggttttgtgaaacctatacaaaatgtatgtataatgtttgttgtagtagtgtatagtatatgtggtagcatataatgtataatttaatatatgataaatagtacataatatatgcaaacataattatacagtattttaaattgcatactttaaaaaatccagagttccactcagatttgtgaaaagcttgtgctttgagcagcatgcaggaaatgagattgactaagtgaaagaacacattcccatctccataccatgcttattctgagccctaatctcactgagggacatagtgagcagagtggcttttaatatttaaattgtctcagaggtaaagcacctatggcaaaattttaacaattattgattcttgatggaaggcatggtatatagatgttcattttagtagtctttccaactgtttatatgaaagatttcatatactaagtgcagattaaaaagaaaatctaatgcaaaattggcaaatgttaaaatgtattcaatctgggtgatttagcactcaagtgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtctcttgcatatgatgaatgaatgtttcagaaaggtcactcagttttttcatattgatatgtctgccttttttgagaaagtacaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactttgcatctacttaaaattattttacataacatcttagaactctttaaaaatggtatttttaaagctgcagtgaaatggataactttatgcagtaattaaaatatttatgttaattattttatccgtgacttaagacaatattcaaaatatatttaaaaagattcaatgtttgctgtgtataatgtagatcaaaaagaaaagaatcaagaaaaaattcgtagggaacatatagcattgtgaacatataatttacattgttcttaaataaatggaccgtaaaagtataatctggtgaatgcccttttgaagttcactgggtgactcaagtctataaaaggatgctttttacaaaactatctctaagcattttaaacaatagcatataattagatatctatatctgtatgtatatatagagagagagagaaaaaaagagagcaaagggggcatatataggtaagacctgtagcagatttattaaggttcttgtttcctttttttttttcttttttgagatgcagtctctgtctgctgcccaggtgggagtgcaatggcatgatcttggctcactgcaacctctgccttccaggttcaagtgattctcttgattctctttagaaagtgataatctttctaaagcataaatcagagtacgtcacttccctggtcaaagccatttaattaatgatctcccattgctttttttttttttttttttttccttgagtaaggcagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaaccttagcctcccaagtagctgggacaggcacgcaccaccaggcctggcttttgtcttttcttaagatgtcatttttccttaatgtctaggggaaaataaaggatagaacatttgaaattaacatcagtgtcatcagatgttgggatttataacttgtatagtttaacagtgatgttagtcttcattttggtttttaagctctctgtttgaaagaaaaaatgagtgattatcccagtcatctctgtataatgttaaattggtatcagttatctcattatatagcctcatacattttaacaaaaaggacaatgaactgtttagacagtgaaggtttttccagttccattaagtttgactcacatgtacaaaagttttaagtggtcatagagacctaacgttccaggcattatggggttaatggttttgaatgtagaaaacgtaactaatcttagtctcaaagatctaaatttaacaatcttggttttgtggatttttattctctcaatgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaaggtgagacctgtgctcccagtgcctggctttgtgccttggctggctattgtagtagctcctaattgctctatttgctcttctttcttcattcttgtacttctaagtccatttgtctcatagtacatggaataatctttctaaagcataaatcagagtatgtcacttccctggtcaaagccatttaattaatgatctcccattgctttttttttttttttttttccctgagtaaggtagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgctttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatcttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccagggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaacattcccaacaccagagggcaaagggggatcgaccattgctcttaatatacattctaggagctggtgtgatcctgttcacttctccagccctaggtggtaccactgttcttcgttttttttttttgttttttttttgatgtggagtctcaccctgtcacctaggctggagtgcagtggtgtgatctcatctcactgcaacctctacctcccaggttcaagcaattctcctgcctcagccttctgagtagctgggattacaggtgcatactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttatttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctgtgggtttgccttttctggacctttcatatgaacggagtcatacaaaatatggtattttaggatgggcttctttcacttagcctgataattttagggttcatccgtgttgtaccatctatcagcaatacattcctttttattgttgaataaatgttttattttatgaatgtacattttattcataagttgatgaatatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaaccgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcttgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaaagtgatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatcctgctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattggctccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaataaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaattttttttttttttttgagagtcttgctctgttgcccagcctggagtacagtggtgcaatcttggctcattgcaagctccgcctcccgggttcacgccattctcctgcctcagccttccgagtagctgggactacaggcgcccgccactacgcctggctaattattttgtatttttagtagagacagggtttcatggtgttagccaggatagtctggatctcctgacctcgtgatccacctgtctcagcctcccaaagtgctgggattacaggcgtgagccaccgtgcccagcctaaaaattgtttttatagatcattgttataaatgggttttaaaacacattttgtataatattcattgagttgatggtctgtaaaatgcctttttttaacttttagaaccttttagattgtttctaataatcctttgttgttatgtataaacattacactgattacctttgtgtgtgatttttttctttaatttttattatttatttatttatttagagacagagtctcgctctgtcacccaggctggagcggagtggcgcgatctcggttcactgcagcctctgcctcccaggttcaagcaattctcctgcctcagcctaccaagtagctgggattacaggtgtctgtcagcatgcctggctaatttttgtagttttagtagagatgggatttctccatgtcagacaggctggtctcgaactcgttgacctcaagtgatccacctgccttggcctcccaaagtgctgggattacaggcaagggccaccacgcccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacatagtatttaacagcttaacaacgtaagtaagtgacctccttattcattatcatcattcgaacatgtttcaccacatgtgatgtgtggatttgaaagtaatgaaaacaaaatgtaagatattttgttgttgttgttgctgagatggtgtctcactctgtcgcccaggctggagtgcagtgacctgattttggctcactgcaacctccgcctcccaggttcaagcgattctcctgcctcagcctcctgagtagctgggattacaggcacctgccaccctggctaatttttgtatttttagtagagacagggtttcaccgtgttggccatctggtctccaactcctgacctcaagtgatccacctgcctcagcctcccaaagtgctgggattacaggcatgagccagcacacctggccgagatgttttaaaaaaaataataaaacttttttttgaatactcttaccttttttcctttaaaatttttttctactacttggtaatttttttgataagactcaaagtttcacagtatttcaatatcattgcttataaagacttaaattggcaatttaaaaagaactattttgggccctttttttttggtaggtaaacctacagttgtggacatcatttattatagtgtcataactttctgaatagttatatcccattcatatctccagtgcaacttgctagaaagttaactctaagatttttatgagatgagattttgagaagctagtttgaactgtgttgcttttctttttacaggacggcctcctggtcctgaaatggaatactgcactgacagaaagtcatactccttagctgctggcttggccctgggcatggtctgcttgggggtaagcatagcctatgccttcccatgcttcagttaggacatctacatgttgagacaaataacgttgacacctaaacctgaatattgtcccttactacgacttaatcttctgcccagctctcttgtctttttggatatttttcaaggtaccagatttgcaaattgagagaaactgtggtcaagagtgagactttaagatttcttttcctccagcttacagtgttcatgaacaaactaaagggaataaagttttttttaaagtgttcaagacatagaatgaataagtgacagcccactatgactgaaaacagagaatagtgaaaatgtatatgatcaggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagatcaggggttcgagaccaacctgaccaacatggagaaaccccatctctactaaaaatacagaattagccaggtgtggtggcgcatgcctgtaatcccagctactcgggaggctgaggcaggacaatcgcttgaacccaggaggcagaggttgtgatgaatcaagatcacaccattgcactccagcctgggcaacaagagtgagactccatcttaaaaaaaaaagttatagtggaaggaattttttctcatgtgtgttctgaaaatccacctcgtggttgaccatctgttagggccttgaattcacattggcacgtgagctaaagaggctggtggtataatggaaaataatcagctgggtgtggtggctcatgcctgtaatcccagcactttgggaggccgagatgggtggatcacgaggtcaggagatccagaccatcctgtctaacacggtgaaaccccgtctctactaaaaatacaaaaaaattagccaggcatggtggtgggcgcttgtagttccagctactcgggaggctgaggcaggagaatggtgtgaacccaggaggcggagcttgcagagagtcgagatcgtgccactgcactccagcctgggcaagaaggcgagactccgtctcaaaaaaaaaaaaaaaagaaaagaatcacacagggaattgcaacttgaattctggtcctaactagtgagtcaagtcatttaactacattattgtctattgcttaatcagcttcatggattgttgaaccagatggccgtgttttatatatagccctgcaacttactataatagctgtataaccttgggcttaatccctctttgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgaaagtattcagatatttacagttcaggtttcaattatataactaatatttttctttattgttaaatgtaactaactctaaagctcttatgtattttaagacagtacttaaagttgaacattcatgtattaaaacttttatgagaattattaatatttattaactcatgattaatgtttgctttaagttggaaataaaaaaaacaaaacccgaaataacctgctttgaagttagttcatttttatatttgttatgggtatgtgttatggatcttcctccataaaatttcttttcactcgtctgttattgtcttttccagcatggcagcaatttgataggtatgtctgatctcaatgtgcctgagcagctctatcagtacatggttggaggacataggcgctttcaaacaggaatgcatagggagaaacataaatcaccaagttatcaaatcaaagtaagtacacagcaaagtaatagatcaaaagtctggaagctgggaagttaattggaaaatactagtgttcatcctgacattggtaaatatgttaattttaagcatacttatcagaggaattttataaaaatttagaactcttttacatgcataaactcttctttcaataggaaggagataccataaatgtggatgtgacttgtccaggtgctactctagctttggctatgatctacttaaaaaccaataacaggtatttctacccactcacccttcctcccacggtgatagtgtgatatcctctctgaccttggttgtaaaattcagttatctcatgtgtttctttcccctgtgctggattaagctgattttcgttctttcaagtactgtaagtttttgaaagaaaactggcagtatttgaagttataaagattttacctagaaataatgtatttggctattttaattgtatttgacaatatagttttcaatttctgttcatttctgttttgtagttgatgtcagtaacacccaaacaatgcccatgtttgttttcattaatttagcatattgctgtgaggactggttaagccagaaatacttatcattagtgtgatcttggctaccatgtaaaacaatggtttttgcctacttcaagagcttttgtaattaccaaaccgtctaccttcctaacttgctatattaatgctgatgcttgaaagtaagatctttggcatttatgcttacacgttgcatgaagagtaagttgagtacaacatgttatgccatgtattaagtctattaattaaaaacaaattctaagattcaaggagcttttcagtgttccacatttctccctttagaaaaagtaaatgtgtgcagaattaacaaagtgtttaaaaatagatatttattattttactatttggatgaatgtgtagggcagtgcttccttggcactggggatatttcattgagcaaaactaaaaatatcttccctcatggagtttatgttatagtaagacatacgtgtacctctataataactattacgttagaaggtataaagtattgtgaaaaatatatagagcagtagtggagtgggaagaaatgttttgaaatagagcttgagattcttgattgtcttgccctctacttgaacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaagccactgtgttttggtttgattcatcccatagcaaaaggcaacttcagcaggccctttctgaggctctggaggggccctggcaatgtatccatttggtcatttgcttttgacaaaagcagacattttagctgtaattggctaaaattctgatctctttctgccctcatgttgggtggtggtggagtggatgtgggcattttgaggatccagcaaaagaagaattgagttgagtcattgagtttgggttccatgggatttatttatgtggtatggagtcatttctgtgtattttattgctagctgtccctgtgtaaaacagattcagaatagtcttcacctccctcgtgctgatttacctggtggtgtaatgtaaatatgcaagaccatagattacatcacgattgtgtcacatgacatgtgcatttgcaggaacatggatggagctggaggccattattctcagcaaactaacacaagaacagaaaaccaaatatcgcatgttctcacttataagtgggagctaaatgatgagaacacatggacacatcgaggggaacaacacacactggggcccatcagggttggaggatgggaagagagacagcatcaggaaaaataactaatgagtactaggcttaatacctgggtgatgaaataatctgcacaacaaacccccatgacacatgtttacctatgtaacaaccctgcacttttatccctgaacttaaaataaaagttgaataagaaaaatagaaatgtacaaagctagaaaagagtgtagctcatcccatctgggaattattccaaatcttacagttcatacataaaaatagtttgataaagattttcctaagtgtgccaagaatcctgaaaacttatcttccattatcgatcctgagctatgaagccagaagaaaaatttaaatctatcaataataaaatactagagccaaaatagtttattattctcttctctcatagactatgatattacaacattattgaagaggcaatcaaagaatatgcaggcaaaaatgttgggaaaggagtattacagagataggtcaggaatttgtttaattaaaattgctattttactgagttttacatatgtttagtggtagcggtagctagagtagactttgctggagtctgggccattgagattggtattattaaggttatgttggcctcatttgctcttaccttctggcatacacaggatacatctcacttgatttctcacaagtctttggtacccatgaccactcccacctttttacaattttcacttttgctggcttctctggactcacactgtcaattttcccctctggctaactgttctcagtcatctctacagaattctcttcttctgggtccttgtgttgttgagggctttatcctagggcttatttttttctctctgagcaagcttgtccacccccattgcttcagtcccacctatctgctgacaactgctgattccacatctccagctcagacctctttcctaggctctacaccaggaattggcaaactttttctgtaaagcgatgataacaaatattttatcggcttgctggtcattgtactgtctctgtcacatctgctcaactctgctaaggtggtgcaaatatagccacagaaaatagtaaaagaatgggtgtggccatgttccaataaaacttgatttataaaaataagcctgcttcatgggctatagtttgccaactcctgttctaaaccagaatattcaactcccttctggaaatttccacttgggttttctcaagttcctaaacataacattgtccccagccaatttcatcttattccctcctatgcattccttcttaatgaatgatccactgtccaccagatgtccaagccagaaattcaggcagcatacttgatttcattccccacattcaatgagtcacaaaatcatgtcaattctactttctcaacatccccctaatccattcttttttctctttctccactgccttctttcaccccctctcatctctcacctcctatgacctcctcactgtgctgcaatcagagggatcaagccacccttggattttaaaagccttcagtaacagtagtccctgcctttctttggctgaagtctaaacttcttgaaacagagtgagaagcctgcgcaattggaccatttccccatgttagccaaattcctctcatctgtctgctcctcctgcctctgggaccctgcacatatatttcttctgcttaaagaatgtgtagcaggtgaagcaactatctgaggccagtataccatgggcagtaagaagaatttaccaagacagttgtagataaaggcagatttattgaagaaagtatgaaaatatgttgcaaggcagcaacaggcaggccagcaagagaggaactgaatgccaagagacaaaggcttgctgggggttttataggatgttgcttttgctgcgtgctgaagagagctttgtgcagtactgataacaccaaggttgcagtgggataacctgcatttttccatcagctgagggcctgatggtagctgggcacaggaagattgtgagctatttgtgcaggagggctatggtcctggaccatgaagaaaggcaaacttacagcttatctgctttctctttcttttttcctcagtgtcaccagcctgattccttttgcctaattaggactccacagaattattctcctttctcatccttccagctgtcttctaagtctcaacttggatgttacttcctctgggaaatgtctcctcacctctcaagactgtctctctgtgcaccactacaacaaatgggacctgggccacttcacttttacaattccagtttacagacctgcattgccccaaacccatgagaccaaaaactccctgagggcaaagatggcctcttatttactcttgattccccagcacctagcacagcactaaacactgtacccactgaaagaacatctgaaggatgagagtttatagcaaaagtggtttccactgacattcccttctctcttccccaactttggattgaggagcccaggagctggtcaggtggcaagataagatgagaaaggagaagtcattacttggggcctctgttttgctggtgttttgctggtgtgtggagatggtgggtttcccttgaatacctgggaggcaggagcaggcatgaactactccagcctctgggttctggacccacatggagggctgctgctctctggcacccatcagtccttaaccatctggtctccagccagggaaggagtgtggtggtggagaagcctctctgtcccacccactcatcccaggagctcacgagaatcagccaaagtccgagttctgcaccctgagttaggaactctataactttagactttccctgaaatttgggaattctcttaactagtatgaaagcagttacatcatcctaggtcctcctaaaatagacacatgtatccaaatataggcacatgtgttgcaaacataacatgtatacatatataaatatatacatataatttttgttttgaaataagtataaacacaacaagttacaaatatagtactgagagatccttgtgcctatggccccgcctccctcaggcagtatcttacataactatagttcatgattacaactggaaagttgccattggcacaatatcagaaactagtctgcagaccttgctcagatttcaccaggttttttgtgcactcatttgctttcctgaaaatattttaaggtttttctacatgacttatctccctgacatactgtgagataagattttttttttctctgaatgagcttagagaacaatcaatgtgagagatgggaaggatgatttggtgcaactctgttttatccatggtgagtctggacctcagagcagaaggaccctcgtctctcctctggggagtcctggtgccacctcagtgcaggctgctaagttatccgggtctgactttcttcttctctgctaatatttgtcttaagcatgtaacacagccatgcttattaatgatgaggagacagccaatgaaaattaattttttcaaagatgaatagatatctagattttttcaagcacaactcaattaagaaaatatcacctcactgagccccaaatgagttaggtctcactgagaaagtgtctcctagtgccaggcaaagtgcctcatatttgtaatcccagcacttctggagactgagataggaggatctcatgagcccaggagttcaagaccagcctgggtaacatggcaaaaccctgtccctacagaaaatacaaaaaaaaaaaaaaaaaaaatagctgtgcatggtggcgtgcacctgtggtcccagctactctggagtctgaggtgggagaatcgcttgaatccaggaggttaaggctacagtgagctgtgtttgtaccaccgcactccagcctgggtgacagagccagcctctgtttccaaaaaaaaaaaaaaaaagaaagaaagaaagaaaggaaaggaaaatgccccctagtggattacgttttaaccactgtgctaacttgagagatagcctgctatctctttacgggacatgagggctgataagcacctcattgcatggtcctggggactgatgaacaaaggctaacatgtggaaaagagcaactaaagaaagaagagccacctccaggttaattagtagaagtctcctcgctgatatgctctcatacactaaaacagcagtaaaaacaacctgcacattggcatcgagggcacagataaacttgccgaggacccttaccacgacagagggatgctttatatgaatccttagtagattaattaagttcttgctatttccagttggaaatgatactgtcctcttagggctattcagagaagttcatcttgatgaagtgagctgtcctagaatggcagttcccgggcagcagagcctgggctcaaggaaggtggaaagagggggtggcgaggagctgccaggtgcaaatgtcaggccagcaatgcagtccagcttgcatggacgtgcatcacctaggaagttgtgacttggctgcattttccacttcaggtgagatggaagggtgaactctacctcacctcctggtgaggttgatgtttcctggtgtttataactttctttgtaaatacttgcaaggaatttaccattttaatgctggaagagacgtctattccttcataagaggacctgagtggatcttgattgcaggccttatgctgggcagagctaaggaaattcaatttgtctccaatcttatttgaatgttctttttttttttttttttttttttgagacagagtcttgctctctcacccaggctggagtgcaatggcacgatctcggctcactgcaacctctgcctgctgggttcaagcaattctcctgcctcagcctccccagtatctgggactacaggagcatgccaccatgcccggctaattttttgtatttttagtagagatggggtttcaccatgctggccaggctggtctcgaactcctgacctcgtgatccacccgtcttggcctcccaaaatgctgggattacgggcattagccaccgcgcccggcctatttgaacgttcttatgcctgctacaagtgcagcagcagaatctccacacatcttgagtgcgaaagtttcctgtagttcctttagcatggagaggctggggaaggttacagactgatttgtactctttagacatatagttgatcattgaacaacacacgtctgaactgttacacacagatttttttcaataaatgtgttagaaaatgttttggagttttgcaacaatttgaaaaaactcaaagacaaaccatgcagctagaaatatcaacaaaaatagaaaaagttaagtatgtcatgaatgcataaaatgtatgtagatacctagtctattttattatttactaccataaaatataacaaaactattgcaaaagttaaaatttagtaaaacttatgtacacactcacagatcgtatatggtgctattctcagttgagagaagtgtatacaaacatcaagatgcagtattaaattgtaactgcataaatttaaccgtagtgcataccacagtacggtaataagttcatagcctcctcctgttgctgttgcaatgagctcaggtgttgcaagtatccacttaaaacgttctgtgatactcaacattccatcatgagcaggtcatccccagtgaattgcgcatcccagtaaaaagtgccctctccctgttcacgtgtatttttcatcctgtttcgcgctgtactgtaaaccttgaataacaccatgggatccacatgaagtggcactagtgatgctggaagtgctcccaacaagcagagaaaagtcatgacatttgacattacaagaaaaacttgatttgcttgatatgtaacagagactgaggtctgtagctggggttgcttccatttcagacagatgattcatcttgtaaacaggcggtgtaaacttactgtatggataaatacataacagtaccatagatgtattttctccttagaaacgtttccttttctctagcttactttattgtaagaatacagtatataatacatataacatacaaaatacatgttattaactgttgctggtcaacagcaggctatcagtagttaagtttgggggaatcagaattatacctggattttctactgtgtacggtcagtgtgccaagcccccaagttgttcaagggtcaactgtaatcctaaaagaatctaatacaatattgtacacagtaagtggtcagtaaataaggaattgaactaaataagaatacataaatctcagaatatgtgcaacctgatcgtagtacacagagatctctctatatctcttttctcagttcatgccattatttcaggtagaaagcaccttattttgaattagttgtctttagagcaaaaatccgtctaagagtgcagtgtggtttcctatgcacaatctggaatagtccattgcttcatgcctaccctggacatgaagggccgtgccacagtggaagtctctatgcatccacccctgtctatacctgagcaactcattcctctttgctgctctcttacaggctacagagtgcggtggcgccagcacagaactctgctcaatgtccctctgtgctttcacgatgctgatggattatgaaggtagggaagaatgtacagccaggaggccattaggagggcaactaatttataaaatcgcatttgtagaatttaatgcatccaacacctaccaggggaaaggtgggcaaaagctataccaacaccacccaagtcaaaaccaaaacaacaggaaaagaaaattatgtggatgtagaatttctgataacatcattcccaagatgccttatccaagaggaactgctacaataatattttaagtggaaataaatacatgctggaagcattatatattagtagactttgtttttttttttccccaaagtactttctcaagcacatcaacataagccccctaagagacatttcacattaaaaataaaacgtctgcccactgctggtttctcaatttgcctccaccttctgtcccctttaatgaactgggccacgaggtgagtcagagaggataaagggagtggtaagaatttgaggagagaagagagtgaggctagaataggaaatcaggaaatgcgattcggtccccctgttcctcacatggggccaccctcttgttgcccagtgtggtttcttcttgagggttctgcatgattcctcaatcccagggaattccacaggatgttccacccaagaccattgggctcccacctctactcttttgccagttaatgaataggcaggaatttcactgcctggaaagaggaacaatgctttctggtccttatttcacatctaaaatagagaggtcaattgatttattgctaaatatctttgaacactaaaatagaagttttacaacatatatactacctggttgctctagacttaagccagggaaaagtacagattcaacatttaaaattgagatagacgctttccacttagtgctaccagtcttgctttatttcatgagaatgagaatataataatatgccatacgttcatttgggggaaagattgatgtcttataatttataattacagaaaacatgtgagttcactgggaataaagaaattttgaagataataagatactttcacttatgtcgtaatttctatgtcatttggtgtaggatgtggagatattaacatttacacctaacttaagtttgtcatccaggacctgaaagggttttgtctatcagctgcacccctgggtagcgacacaaccttggggaaggcctcagccccatccctcgtacagcaggaatgagaacagcactgcctgttgggaagcttgagggaggctatggacgtgcagcgcttggcagagggtctcgtcatggaaggttccagcaaatgtgagatacttttctgatttcattttctccaaaagaaagggaataaaagaagaggggaggaaataagactaattgtgagagataaagtacaaaggtgagggaaggagtaaggagacatgaaggcagcgtggagcagctgaggggggagattgctttcaccacttcccagcatctattgcagattccaccctcaatcattttgtaaggaccctttattcaaggtcatgtttgaaccctgctgagccagtggcgtgggtgtctgagagaatcattaacttaatttgactatctggtctgtggatgcgtttactctcatgtaagtcaacaacatcctgggattgggacacactttctgggcactgctggccagtcccaaaatggaacataaggaagtggttcttctacttcttttatttctgaaatcaggtaagacatagtttttttaaattataataattattttttctcccacaatgcagtacaaatacatatgccatggctttatgtgcaattcatttaatttttgattcatgaaactcccagttgaaaatcttgtataagattgaggaattcttcaagaaataagtttagttttcctgtgaagattgtcagcgtgctggaatgaatgcgcagagaaaataatgggtggtttttcaaatctaaatgagtgcacccacataatggccagtctaattgaaaaagagccaatgtagctaactatgcaaaggacggctaagctcttcgcctggttctcagtttgactaatttatataatctctcttacggtgtcatgctcccctcacttgcaagttaaaacaatgaaatttctctttgaatatattctgttctctcaccagttcatggtggtggcagcgtcagggattcagcatttctccctttgttatggcctgaggaaggctttccatcagtatacgtttgcctctaatccccggaaaaatcacacgcatccatttgccagatgctgtgtgcagacagtgattcaacaaatactcacttagtgcttgggttaggtcgctacatttttacacatacatacatacctgtgtgtgaatgtgagtgtgagtgtgtgtcctttacaaatactagcttatttagctcgcggtataggtagggtagcatattcaccctcattttataaacaaagaaatctagacaggaaaatcatgttatttgctcagtgaccaaattctcaaatctgggaaataaagaaaactggatttaagccaggtttcccagaaggaatctagggctcttctcacttttcagctttgtttaagcctttgaaataatattctaaacatgtcctagtagttctttttctttttctttttttaaaaaaaagctttatggagatataattaatgtatagaattcacccatttaggcatacaatccaatggatttcaatatattgagagttgtgcagccaccatcagaataaattttaaaactattcatacccccaaaaacgcactccactctccttagctgttacccccgatctgcagcttctggcaaccactaatctactttctgtatttatatctttgccattttgaacatttcatacgaacggaatcatacgatttgctagtagttcttcctgtaaataatgtatacttgaaattcaatctataaattaccagataaaattttacaagttgcactttagagtcaaatacatttgaatttagtggaagccattcaaggagctatcaaacaaaatacagagcaggagaaaattaaagaaatttttgtaagaaattggtgtatgttgggggtgtgaatattatatttcaatgcatggaaactatgacatagatcactgtgaacttattcagtgggctacacccaaaggctagaacaaacttctccgccacaggattaccaatgttttaaccaacctggggggaacattctctcataagctcttttggaaagccaggctttctgtggatgtatcatctttccagtgtgctgcaatgcccggggagaggaaaaagtttcttttacagccatgcttagtgggaagtggagaaacatcttccatttcacaaattaagtcttttacacatgcaaatatgcatacacattcacacaccacagtgaggaagaaattctcacaccattaataaaatacatttgcatcagtagcaatatacatctgcattttgcctataatataaatgtatttttccactaaaagatttgatgtttccttgccagcaaataagccctatcaaatcctattgccatatgagtcctagaggtgaataagagaaaaaaaaaatgggggaaaattatttcaaattaaaaagaaaaaagtttgattctgttttgggatatttcctagggacaggagctggggaggggatctcagcagcgatgcgctatgaagtataataacatgacacagagaacttaattgaagggggaaataaatggaagttttctttttttgaatatcaattgtagcctgctctgctatacttcaaaaaaactcttcagaaagtttaactgaactcaccgtaggacacactttgtggatttattgtgtgttttgaagtcacactgcgagctatagaattaaccaaaacacaactcttcttggaaatgagagttcaagttggcagaaagtgcggggtaaagacatggatatgggcctaaagcatctatttctttgtgatcttttgatacatctctcaagtgcttttcagtggattaggtttagaatgcatcagccaactcctgctcaataatccatttttccagcccggaatgtcttaaattgaggaaggacgaagtcccagaggtggggagcagggggactttggccgaggactttgcatgaattgatgagcgtgcatcctcctccctgtgctctgtgtaccctcaggaggtcaggacgggcctttctgagaatgagaatctgttcatttgccttcctactggatatttgtcatcagcatacaaaccagtgcgctctgcagtgtgtcatctttcagaacctcccctgacctcatcttccctggagggctcgctgtcttcagagccaggcttgtctcccgctgccgcctccactgctctcctcgtcactctataacccactccctctgcctgcagcccccaccacgcccctcaaagtggtcaaggttgtcctgttgtctaattccatggagcttggctatcttcattttattagcctcttttggcctcttacccctgtgaaaatcactagcattctgtgcgaaggatggagctggcatctccaggcttggaatagacctaccaaagctcagccagatgtccggaagagcctcaggacaagggaacaccctgtagccttgtggtgggagcacagctgaggcccccttggccaccctctgccacgaccaggcagaaagcagctttcggacagattcgttgtctcagatttgatctcaaagaaaaaccaagaccagtatttgtcccaggttctgcttttttacaatttcctccgaaatccagatacctgtcaacaccttggaaaaactgatttctccccagttagtagtgttgtgtgactgtcatcagcccagtacaaaaatggccttctttgttggggagcttcttaccctccagtgttttgcccaatttttgtccaagttggcaacataatttagttcagttcttgtttatttccaccatcatctatgcaccaaaatttatgtgtctcaaggagggaccattcagaggatgcttcccaccagttcaagtgacagtgtcagaaccaaagcgcatattgtaggaaatcaaacaatggcctccaagttccatttctacccagggatgaacaaatcaacatcaatcttggtaacacaactgccactgatggtgccttactcttctctcatgacatggcacaattgatagcaaacataaaatttgttcttgtttaaggatttatatccactaatatggtaacatagtagtggttccatagttctaacctgtttatcaatccagttaatcttttactatcttgcaatctgttaatgaaactgtttttctttgttttataatttcaacttttagagtcaggggtacatgtgcaggtttgttacatcactaaattgcgtgacactgagctttggggtacaaatgattcccatcacccaggtagtgagctaaatacctactaaataggtagtttttcagcccttgcctcgctccctctctcccttctctggtagtccccagtgtctttagttgccatctttatttatgtccacatgcccaactgtgtgttcttaactaaacattttgattcatagctacccattctacttccagtaaacagcaagttttatttggttaatgctaaccaaatagattaaaaggaagtcatgacaattagacattggcattgatttactgaccatttattccacttggatctcccacctctaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcaggtattttcatcgtcgttgcacctacccagaaatctgtaattcagatggcaagtaatttactcacaaatttattaacgatttaagaggaaagagaaatttatggagccagagtttggaactatatttgctcatagcatgtgaagccatactaacagcttcttgttaaggtttactggagtcttcattagaaaaataccctaaaaggaagttatttgtttttacaccggacataaacattagcagttattgttctgagctccagtttttaacatcatcatcagtaaatgtttgttgaggatcatatgaatgaaagtgtcctagatagatctgagcaatgacttatagctacaagatccagtgcctgcccttcagtatttaaggtgactggatataatgttaaaaaaaaaaaaagacagcctaagtgagctacaggcataatcaatgcatgttctacccagatccagaagaaagaacagtgcctaaggttgaggcagctagagaaggctcagggaggaggtgggaaccgagctgggtttggagttgagagagctcttgaaaagcaccaggaaggcaggggaagatgcggccctgcactttctgagggggaccattaagagatcaagttgactaaagcagagactttgtgtaggtgatgagcctgggaaagtagctatggatgccagactgagcacccatagcaggaccacgggatggagatgggaggggtcaggggccagggtggggtggaatgtggggcagaggttcaggggaactgatcagagttgggaggtcatggagatggactatcttggggaatgggttcaaagcaaccagagttgcttctttctgacccaaaaacaaaaattaagaagatgagtgaagaagaagtaaaacagttgaaacagaaagaaagagaaaattatgagggagggaaggtaagggcagataagatttactgccacgttggtgtattttgttcagtacttcatcaatgccatgcccaaataactgaaagaggcagcaattctgagctctctggtccctcaagatagtcaatgatctttagcatttctcatttattaataaacatttgttttctttaaataaagaaaaatacttattggatttcctgcttcgttctgcagggcattccaatatcacagtaaagagcaacaatgtgtgataatggctgaaaacaggaagtcctccataatcattaggatgagagatgcagttttatttgaaaagtaaagtgagtacattttcttcctcctcctcctactgtcctccccatcctcccactcttcctctttctctattctatctttaatttatgagaccagaggaggaaggcgctatggtgttgtaaaattgaattctgagttaggacaggatttgattactaactaaccatgtcagcttgagtatattacttcacctcctagatttaatttttttttgttcaaaaaatgaaaggattagatttacaaaatcacttctacctctatgaccctgaaaataagatttttaaaatattattttatatttaacaaggagatgggaagtctaagcattccttttggtcttggcttcttattctgcagggtgaccatggtccttgggccctaacatctggacgaagccttgtaaaacagaaatactgaggtgttttaatcctcagaaacatttagattgggacacaaatcttattttttactcttaaatttttcacattttgggggacatggtctatatttttctcagatttctgatatgttgtcttttaaaaatgtgtaaaagttacagttccttttctatagtttattttaaaatgtgggtcaatagtcccactgcttagaataagaggcacacaggatttcaatagaaattgcatgcctttttagatgtgcgaatgtttcattaagcgtatgaatatttgaagagatgtatgacactttaaaaactgtttcctctactgtgttggtggccaggtattaagactgttaataataacaatttagctctccaaatatcctgcatcacaggtgttaaagaggactggaaacaccttagttcttgtattcttgaggatgatttgccatattgtgtctagtatcacggcaaaactccaagtagcattttaaatagtatttatttgggttggaattatttctatgcattgactcatcttcctgggtttcattagctgtacgcattgtactttcttccttaccactatttatctcgaattcttgagattaaagtacagatgaaatctaaactttatctggtaaagttattagttcttacaagtagcaagcaaacggtaaactaaataggatgacctaattgtaccagatttaaaaaaaaaaacaaaaaaccctgattctcctgattctctctacaaaatgctaacatttaaatatgtcatttgtaaattgttaaccagaaggaacatgggaatgactgtaggttgagtttgaagtgtgaagtttgaaggcttagtttgcttgttttcaaagtgacagaagggagcaaaaggttatataaactccggtgggtacatacagttgctgtgggatattgacctgctgctaacttacctgccagggtttttccaggaacagtcagtgttagatcacgtttacttctgccacttgccaccagccacactgccttcaccgagtccaagaccctatcaccactggttggggctacttgtagctgtacacctgatctcgaagaaatataacttccctgtttaaagcccttcctagtgcccttaaaataagacccaaagacttcccaaatgtgccagggcccggcattatttacgtaacccccggctgctgtttgcttggcttgctaaacttttctacaaagtttctggccttacttctgttccttcaccaccccaagcacacgccctcctgcctgggaccctcttcacctttgtcctgctgtgccagctccttcttatcgcctaggtgtcagctcaatcatcacctcctttgcaaatcttccttgacccctagacctccctttcacaaagtaccttgagtttacactttgatgagtgtcttatgtctactgtaatactatgtcccaatgaagatgtactggcaatcataataggtagtattgggttaaaagcattagtttgctgtaggtacgttaggagtactccccatgtgattgatcagtgaatttaaaaatggctaaagtgggtaaccttaaatgatggtgcaaatataccttaaacattttatattttcattgaaaacacaagtgtacttgacacctcttgatgtagagcagaggctttttttcttcgaatatggggtcaccagtagaaggtctctggtgcatttcctgcataaactatgctctagtgcaacatctacaataattactttccttatttttgaagtggaccatatctcgacatttattaatcaatctgcatgtgtaaaacctttagatttttatgaattcctcctcaagctttatagtcaactatatgagtggattgccctctgtggatctgatagcaattttttaaatgattcacgtttcaacttgttaaaaacatttaatttagttaaaaaccaaacaaaaaagagctttgtttcttttcacattcatttctcagtttagatcatctttaattaaatataaatgtaagaaagttggaaaatgcaaagaaacgactcgttgtaagcacataactcacgtggggggaacagacatgggtgggcacactagcaaacacctgccagctgcatgtggacccaggtgggcaccggactgttttaaacacaggagagggcccattgtctaactggtgagttggttgagtggaagctggttgagaacttttactgcaaaccatttacagtagaccacaattttatagtcctgtttggcactttttcatatcactgggagcctgaagaaatagaagtgggttggatctctttcagcctcggaaaagcctgccattcccccatctaaaaaccctttccccattctcttactctgtctcatcatgtatgtaacatgtatccatgtatcatcattaagtgatctcattttatattgtttacttgaatatttcctgtaacccccctgtctgattccactagaatgtgagctctatgatggccaagcctctggctgcactgtgccccgtgtgtccccagcatcctggtggggctcaatacacagagagctcataagtagcatttgaatacatgaatcaaagtatggaatggcccagtttactgcagcctttttgcaggtgcaaaagatgatcttttagaaagcagaaacagggggtctggtgcatgagatctttttctcaatgtgactgtgctgtgcagaccttcacgtggtgtcttgtgaaagactttgaccactgtgtggactttccttcagtgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaaaatctgaccacacaaatgctgcagcacccagctgaaatgcatttggatgacaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctccgggttcaagcgattctcctacctcagcctcccaagtagctggaattacatgcatgtgccaccatgcctggctaattttacatttttagtagagacagggtttctccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaactaaaaaaaaaaaatacctactgaaaaaactgtcatcgtttcacatttctggctacgttagtgcaaaagggaataaataaaggtgagatttgtgtgacagtgtggatatggtactgtgtgacaactcagttctcccatcacttccacctgtttgaatcatcgggatcctttatttgtacaccatgttatcggtatttgcccttaagcaccaccaatgcaccacttttatattaagtctgcccgttttccttagtactccataaaatttaagtcacatattactctgcctcaccatgttacttcaataattctgaatcaaagtttaagtttgtgaataattttgcaaaaaaagagccaatcatgcttctcaacaacataaaaagagaagcgccgtcacttcaggtgaatattgttctccgtgaggccatgagcataaacaaaaactccagactaaaaccctgagacggtgccaggtcattcagcagtcagcggaatgatcagtataatttcaaacaaagttttaaagatcattattgaaatgatgtattttgagcttcctggatctgttcctttatgtctaccttagttcatttgggctgctgtgacaaaaatatcataaactggagagtttataaacaacagaaatttatttctcaccgttctaggggctgtgatgtccaagaccaaggcactagcagtgtctggtgaggccctgcttcctcatagatgacacattctggctttgtcctcacatggtgtcaggggctagctaattccctggggcttctttcataagtgcactaatctctgtcctgagggtagagccctcgtaacctgattgactcccaaaagccccacctcagtactatcacattgaggattaagtttcaatataacttttgaggagacacaaacattcagaccatagctttatctatcatgaatttgggggaattttcagtcactgttgcttcaaatgtttcttctgtttctttctcttttttttttttttttttgagacagagtcttgctctgttgcccaggctggagtgcagtggcacgatctcagctcactgcaagctcctcctcccaggttcatgccattctcctgcctcagtctcccgagtagctgggactacaggcgcctgccaccacgccccgctaattttttgtatttttagtagagacagggtttcaccgtgttagccaggatggtctcgatctcctgaccttgcgatctgcccgcctcggcctcccaaattgctggcattataggcgtaagccaccatgcctggctttctctttttcttctctttctggtatttccaaaaagtctccatgttccaccttttgtaattgtctcacagttcttgactcttgttctgttttttctttttcattcttttctctcattgtgtgtcagcttttgaagtatctattgacatctctttgagctcactgattctttcattggccatatccattcttttgatgaacccatcaaaggcattcttcatttctgttatggtgttttttatttctagtatttcatctttatttcttcttagtgtttttatctctttgcttacattacccatctgttcttgcatgttatgccatttttacattagagcccctagcatgttaatcttagttattttaaattcctggttggatacttccgatatttctttcatatctgagtctggttctgatgcttgctctgtctcttcaaactgtggggtttcttgtcttttagtatgctttgtaattttttgtttgaggctgtatatgatgtactgggtgaaacgaactgagttaaataaggctttagtatgagattttgtgtttctctggctaggagttaggctttgtttactctttgctatatagtcatggatgtcagaggctaaaatttcctctagtgtccttgtgttgtctcccctgtcttctctggggagctccctagaggcttctttgtaaagtagctctgagtcttgcagtgtctatccctaatcatgggaaaacatcaaacaaacccatacagcgggacatctgacaaagtaccaagtgtcaaggatcatggattgaatcctgaaacagaggaaggacactgaaggaaagactgggaaaacctgactgaggtctggagtttagttagtgatactataccaagacgaatttcttagttttgataatttgttaacagttatgttaacattgggggtagctatgcaaggggtgtgagaatgctgttatatctttaaccttggcccatggttaaggtgtttccagtgtaaggtcactgttattccttgtagttaacatatatttggcaccacaggattcattctggaattctccttggcttatttataactttttttctagtagtgagaaacctggctttcatgcagagtttacaaacgccaatttaaacttttgttttgtcatacgcaatgattttattacctgtctttatttcagagcttatgaatttttaattattctaagggctaacatagaacttttccatgttttctactcttcaagagtaggtaagactttagtttgtaatacattacaaaaggaatcctgtggttctctaagagctaatttgtcttggcaaaaggccttagcaagctgtgagtggtggctcatgcctgtaatcccagcactttgatctgagacggctggatcacctgaggccagaagtttgagaccagttttgccaacatggcgaaaccccatctctgctaaaaatacaaaaaattagccaggcataatgccatgcacctgtagtcccagctacttgggaggctgaggcaggagaatcgcttgaacctcggaagtggaggttgcagtgagccgagattgtgccactgcactccagcctgggaaacagcgagactgtctcaaaacaaacaaaaaaaccaaaaaacaaaaaaattagacgggcgtggtggcatgcacctacagtcccagctactcaggaggctgaggcaggagaatcgcttgaacccaggagttggaggttgcactgagcagagatcatgccgctgcactctagcctgggtgacacagtgagtatccatctcaaaacaacaacaacaacaacaacaacaaaaacaaattaaaaaacccaacaacaacaaaaccagcaaacaaaaaaactaaacaggctttagggaaagagcaatctaattatctgattatatgattggcactaagatgggaatgactctggcctgatttcttcagtttacattttaaaataggagcttagttagcccccaaataatatgtaattgatgtattagcgttggggagtgaatatttttcaaagcagaagatatttctcaattcttgcttacttttagaggttgaagttcaaggaagccccttccttggcactgtatcccagggaggtatttggagttaatttcagggcttagcagtgactctttagaaaagcagtatacgattgaaatgtaatgtgttacaaatgagatcactacaagtaatttaaaaatgtgctagtagtgtttttttttctgagacggagtctcgctctgaagcccaggctggagtgcagtggcacgatctcagctcactgcaagctccgcctcccgggttcgcgccattctcctgcctcagcctccctagtagctgggactacaggcgcctgccaacacgtctggctaattttttgtatttttagtagagacggggtttcaccgtgttagccaggatggtctcggtctcctgacctcgtgatcctcccacctcagcctcccaaagtgctgggattacaggagtgagccaccacacccagcctctagtagtacttttatcaaaagtaaatagaaacatgaaattaattttcacaatacattttatttaaactaatatgttcacaatgttaaaatttcaacatgtaatcactataaaaactactagtgagatatttcacattacttttttcatgtaagcctttgaaatctggtgtgtattttatatttactgtacatcctgatttggaataaccacatttcaatctttcaatagccacatgtggctagtggctactgtgttagagcagttctagaacaaaggagtccctttaaaactattttgaagtcatcgtctataaggcaatatgaaagctgatctgaatgatttctccttttccaggaaaggaaacaaaaatgaaatcatgttagggctgcatattttatggatcccaggagaaatacacagtctgaaagaatgatctcagtcagaaactcagaatgaatcatatgaattaaacattggacaatgtccaatgctcagcatgtgtttttggtttatactaagagcatattatgccaccaaatacagatatttactattatacttcgtgtaggaggtatattgagacattgttctagactaccacagttccatattttgtgaaaagttatattgcactttttttttttttgagagtgtgcccaggctggagtgcaatggcatgatctcagctcactccagcctccacccccccaggttcaagggattctcctgcctcagcctccctagtagctgggattacaggtgggcaccaccacatctggctaattgttgtatttttagtagagatggggtttcgtcatgttggccaggctggtctcgaactcctgatctcaggtgatgcacctgcctcagcctcccaaagtgttaggattacaggcgtgatccaccatgcccagccttatatttcactctttgggaattgcatcttactgtaatcttaaactacactaaaataaataatgtaaaccttttgtcaaattgctcagagtaggtttctactttggttataaggaataaaattcatgcttttgtgtacacactagacatctaaagcaaccaaccatagttaacaagcagtgctcttaccaaaaggtaactctttctagaatctggcacaccatttaatatcagtatgagcatatggtgggtttaataattgttttccatgtttataagttttctttagttttataagcagttaaaatgaatccctttcactgaaatacaatctgtggtgggacttctagcttttctcgatcttacgctgctagatttatgtcactgccatagctatgcaatgggtgatatttacactatgctcaaacaaagcaaccagaaaaacacatcattgaataatacagatattctgaagtcaagcaagccaactttcattaacagatcaatttccttagaaaagttgatgaaactaaagactgaagttcaaagaaaaagccctctcaagggggtatgaatttctggtaacttatggggtaagaaaaagagcaagaaacttgaaagtagggaagagaaaaaagaaaaggagcaagagggaatagccagctctcaaaagagtctccaataggaaagcaaaatctgtatctagccagtaccaacatgtgaagaaagagtgagcatagcaaaattgagaaaggttgcttgaaaaccaaacaaaaaaccaaatacctgtaatcctagcactttgggagggtgaggtgggtggattgcctgcactcaggagttcaagaccagctgggcaacatggtgaaaccttgtctctactaaaatccaaaaaaaaaaaaaaaaattagccaggcatgggctgggctgggctgttttccaggctggtctcaaattcctgggcttaagtgatcctcccacttcagcctcacagtgttgggattacagtcacgagccactgtacccaaccatatgtcattctttagacacactgcttactaaatttctctttttaaaggatatactgaatttccggttgagccaacttaacagctaattttctattttagctttaaaacattgataagcaacatgaagcaatctagaacttaacctttaagtggctttattaaagcaatccagctatgaaaattatgcagaaatgattatctacaatcttaccagcacataagaaattcttcctctattctgaaataccatcttctcacaatatactttgatgttatgaatcaatgtctgttcttgaacattatttattgtctttctctattaaacaattccaaaataaaatttccagcacaactaaatattgttgatgataagaggatttttaaaaaagttcttttaaaacagaagcttatatacaacttagaatctaaaaccaatagatttatggtaaaccttaaaactgaaccaaaacaaacaaaaaccaaagttttaatcatttaaaaatcatgtttattgaggtacaacttatagtaaaacctgcccttttcagcgtatagcactgagtcttgacaaatgcacagttatgtaccaccaccgaccaaggcctggcacatttttacctcctcaaagttctccctggctgcttctcccactccttggcaaccactaacctgttttctgtccttatagtactgcttttttcagtgtcatataagtagaatcacactgtacatagtattttgagtctgacctctgtcaactggcataatgcatttgagaattatccatgttgctgtactggcagtgcattcttttttattgctgagcagtattcaattgcatggctgtaccagtttgtttattcatttgccagttgaaggataactgagatcttcctcgtttttagcaattttaaagaaagtttctatgaataattgtgtacaggtttttaattaaatgttttggagatataattcatataccacataattcacctttttaaagtgcataagtcactggtttttaatatattcacaaggtttgtgcataggtttttgtgtgaatactggttttcattcctcttggataaagatttaatttggtattacccttccagacacctttctgtgttttcatacgtatatatgtatgacggtttgaccttaggcagagtagcattttcaaaattttacatggggaaactttctagatttaaagccattttatttttctgttctgtctggttttatctacgtgttatttacaatctgctgtgtaacaaattactacaaacttagtaccttaacacatatttatttcacagtttctgtgggtcaggagatcagaaatggttctatttcaaggtctctcacagggctgcaatcaagatgttggcatggctggggtctcatctgaaggctggactggagaagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtatgctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctcagatctggcaggctattgtgaggcaatgtgtcattttaccttataacgcagagttgtaacatgctactctgagcagctcatgacatctgcttgaaatttaagttgggcccctagtatgtgtttattataaagattttgatgctgcttttcagagttgggtaacctactttacccccttagctaatgtttcccaaatacacccaaacccacagaaaggaaaactattcctcattaactcacagccaacatcataaacattttatatctagagctgatgatacagtcaggtatttaccaacactcatgtatatatgtagagtttcaagaaataattgcttatccttactagattcaacatattctaatgtttcacatattatttttatttcttaattttttttttaaagatggggttttactctgttgcccaggctgaaatgcagtggcatgaccaggatttcgaccagaagtttgactgcagcctcaaactccttataacaaagaatcctgctgccttagcctcccgagtagctaggactatgggcacatgccaccagatctggtatattttaaaatttttgtagacatagggtctcgccatgttgcccacgctgattctgaactcctgttctcaagcaatcctcctgcctggtcttcccaaacttttgggcttacagctgtgagtcactgaccccagcttgtattcttttgattttaaaaaaatattctgaatgtgatccaccaaattaatttcaccatccactaataggtagcaacctgaatgaaaaatactgttataaactttacacaaaaccagagattataaacatttgcttccaaggagagaggtaaaaggtacttgtttgctctgatgggccctgtttccttcagtgccaggaagagtggctctcagacctttcttctggcatccctcatgtatgcagtgttggttattattttcaaggccttggtaaccaaatgcccctagtgtgaccagtcagactgacagtccatatctgtaatatggtggtaagtttcctttgcatgtctttctttctggcatcttagaacttttacctaggaaattttctttttgcttgaagtacatcattaagaattttcagtgaaggcagattcttaaagtttttgttttccagaagagatcttggaaaatataaaaggttggcagttatttcttttagtacatgagatagtattacaccaatgctgttgagaagtctattgtgaggcaatgtgtcttctttctctggctgcttttgagatttctctctgtcttttttaggggcagttttactcttatgtgactagaagtagatttcttcttttttttttaatattgcttgagattttattgggtttttgaatctgtggatagatatccttcaacagttctgaaagatttccagccattctcttcatatattatctgtgctgtattcttgtctctccttttagaacttcgattagtaaaaacatgtttgatgtcttttcccactcttgttttttgtttctcccatgctgaattctgtgtaatttcttttgaactatcttgtagtttacatttttttttttttttttttttttttgagataagagttttgctcttgttgctcgggctggagtgcaatggcaccatcttggctcactgcaacctctgcctcctgggttcaagcagttctcctacctcagcctcccaagtagctgggattacaggcatgcaccaccacgcccagctaatttttgtattctgagtagagacggggtttcaccatgttggccaggctggtctcgaactcctgacctcaggtgatctaccctcctcagcctcccaaagtgctggattacaggtgtgagccaccgtgccaggccttacattctctctcttaaagagaaaatgtaaggtatctaaatctgctgctaaaccatcattgtttttaattgtaataaggtctcttttatgtactcacattgataagagacaagtaggaaataatctttaaagggcaaactaatttaaatgtgttttcctgtctgtttacaggacttaccaaatgcacatcttagagttctgggtttctaatgtgtatctcctctatgaaattctttaaaaatatctgttcttggtatcccttaggttagtctcttttagaacttctaaatcaatggacccttaacttataggagccacctggacgttagcaacgtctacattaaacatgctgagcttttaaaagagacctgttagacatgctgagtattttgagataatatcattgttgtattgaaaactattgaaaactttaattttaaaatgcaaacattcttaaagtcctggttaattttataactataaaattagttataattttgagatttctgtcttgttttttataggggcagttttactcttaggtgactagaagtagatttcttcttttttataactataaaattaggtttacttttgttagaataaattaaagacagtgaacttgtaatttgaataactactaaaaatatacatgatgtattcttatttgggcccttgtgacaaaaatactattgtggctatagaaacctatcctatagtttgaagaactgagattactgtcagtattgagaacattcctccttcatcattagaaagattattaaaaaccagattcaaagaaactatcaatactacttatgaagtatgtctgtaaaaaaaattaagcctgaatcttatcaggcctctagaccagggattctcaaggtatgggccccagaccagaagtatcagcaacgaattgctaaaaatgcagaatcttgggtcagaaattggggaccagcaattggaattttagtaagtataccagatgattcagatgcctgctcaattttgaggatgactcttatcagtttagttattaggatttacaggggatggggaacatgttaaagagcaccaactagataaggtcaatcagtcaaaagtaagatgtctggacattctgggcctcctgatgtcttagaaagcacacaataccatctatggtgtatttttgtccaccatcccacccaattgcacctggatcttcctatttataggcaattagaacaagctcagtgttaccctgtaatgattaaaaaccaaatataggactgctatagcataaatgaccactttcttcaattaataagtggcacattaaaaatatatttatatatgtaattgttatagataaaaaaaacaaaatggccgggcgtggtggctcacacctgtaatcccagcactttgggaggccaaggcgggcagatgacaaggtcaggagattgagaccatcctggccaacatggtgaaacctcgtctctactaaaaatagaaaaattagctggcgtgcatctgtagtcccagctacttgggaggctgacgcaggagaatcgcttgaatccgggaggcggaggttgcagtgagccatgatcggaccactgcactccagccagggtgacagagcaacactacgtctcaaacaaacaaaaacacaacaacaaaataaagcttaaggaacatcaaccaaatgcaatatatgagccctatttaggatactataaaaagacattcacaataacacaggcaaaatgaacataaactaggtataggtgacagagaaatccaataaacattgaattattcactggggaaagaaatgatgtgtgggatttaagtctctaactctcccctatttacgccaaaagattgtccatgagttgaaaaccgttagagatgggtgacaactcaagagagattatagcgtcttccttgtgcttgtaaatgtcaaaaataaaagtaatttaaaactaaaacaaaaatgaaaccataattcttaagatgcagcttgaattcagttaactatagcagttgtatatgaagcatttcaaagaagttaatgacatcacagtattaaatccatctgacatggaaaccaactctaactacatcatagttttttttttttttttttttttttttttttttgagatgggagtctcgctctgccgtcaggctggagtacagtggcgtgacagatcactgcaacctccacctcgtgagttcaagcgactctcctgcctcagcctcctgagtagctgggactacaggcacatgccaccacgtccagctaatttttgtatttttagtagagacgagatttcaccatgttggccaggatagtctcagtatcttgatcttgtgatccgcctgcctcggcctcccaaagtggtgggattataggcatgaaccaccagtgcctggcctatggcacagttttaaaactgcatttgcctagaaagtggactgctgtatatagaccaagtgttgggctatatgactccattgtcttaggctatttggggttggaggaaggaagaggggtgaagtagaaaaggaacaagctaataaatgttttttaaaaagtagaatttaaaacaaaaccacgttcagctgaacaccagaactcaacaccaggataaaaatccaattttcaaagagctagaagatcaagctaagcacttattgtattttgctgaacgttaaaattatataaatgtactacagttgcctcaagatgttaaaaagtcagcttttcaaatctagtcacggcctactcatatgacagacccaatacaaatgagcaaaattgaaaagttacacatacagacaacttctcaaccaccaggctgtttagtttaagttagaagtcagaagttctgagactctccttttacccaccttgagcaaccgcagcaagttttcccttttcttcagggctgagctgcaacatcgtatttataacaggaagaaggctctctctctcactacctggcttcaagaaaatgaactgcagcaagacgttcttcaagtgttccacgttagctgcagactcctcttgattcctttccaatcttcttatttcacttttgagaagctggtgttagagaaatgagttaaaaatgggctttaggagcttctgattaaatatggcagactgaactcatgtatttttcttctcttccccccaaatttcccccttccctccatatggcaataaaggaaggaattcagttaactacagcagctgcatgtgaagcatttcaaaggagtttatgacatcaccgtataaaatccatttgacatgaaaaccggaactccaactatgagatagtttcaaagctgcatttgcctagaaagtggattgctgcatatgaaccaagtgttgggctatatgactccattgtcctaagctatttggggttggaaggaagaggggtgaagtagaaaagcaacaagctaatacaagaggagaaaaagtagatgagataacgtcaagacattctcacgagaaacagatgaagaggtggaaatgagtcagtccagcagcttaccaagtatcactgacaggagaggatgcatcctgtgtaaatactggagttcttgtctcagaagcacagggtatcatggaaatggagttgaaagctggggaactgatggaacgtctccatgaggagcaactaactggagccatgggttggtaccaagatgttccctctgccttctacttttgatagaaactaagccagtatggcatggggctctgaaaatgggctgaggggaacatcggtagcctccactaaccccctgcccctacgctgttcctgaagtcccaggcagttaagacgtccacagtgaacggcacttaaaaagttcagacacagtgaaaattcaggaatataagacaatgtaaaacactatcagagaaatgaggcaaagaacgatataaaaaaggtagtatcatgttcaagtctttgaggaagatttccaggttgaaaccaagccatagcttttagtatattttcattttaggttaggcaagaaagttagcgaactttgtcctcaaacctaggaccatttaaaaaagtgacaataaagaagacgaagaaatcatgaagagagtataaatttatgaaaatataacatttggccaggcgtggtggctcatgcctgtaatcccaacactttgggaggctgaggcaggcagatcatgaggtcaggagattcagaccgtcctggccaacatggtgaaaccgtgtctctagtaaaataaaaaaaattagccgggcatggtggtgcgtgcctgcagtcccagctactcgggaggctgaggcaggggaatcgcttgaacctgggaggcggagattgcagtgagctgagattgcaccactgcactccaaacctggtgacagagcaagactatctcaaaaaaaaaaaaaaaagaaaatataacatttaaataagtcatttaggtttactgggctagttagtgatttgttagctatgataatgtttttattagtgggaaaatgctattttatagagatgcatactgaagtatttaatggtggaatgtcatgatatatacaatttactgaaaataactgaattcggctttaaaataatctgacaaggatagctagtggccttgcacagtggcaggacagatctactaggaacagcaaagtacaggggaaaagcatgtacttttcagacagctatgagtttgaattttgttccaccatttaccagcttcaatttttctctcaaccagtgatgagattaaataatgtatgtagagcccagggcctgggtcataagaactcctcaataagcagtatgactatattctgaggggtgatttatcagtgagccagggtggaaatacctcatttgagtaatcctcaactgttctgcaacattcctagatgtttctggtgtctactttaaacaggaaaaacttcccatgccactttgccatctccacctgaaaactgtttagtagttcagtactataaatatcagttgaataatttaaattcactggttatctttagaattcaaagactcacacccattttttatttaagcatatgtgaacaatgatttgtgaacatctctctagtttctaaatctattacggtttcttaggaaaagtaggaattaagaaataatctttatgtaataggtgtaaaagaagtattttggctggatgcggtggctcttgcctgtaatacccacactttgggaggccaaggcaggtggatcacgaggtcaggagatcgagaccatcctggctaacatggtaaaccctgtctctactaaaaatacaaagaaattagccaggcatgttggcgggcacctgtagtcccagctactcgggaggctgaggcaggagaatggcgtgaacctgggaggtggagcttgcagtgagccgagatcgtgccactgcactccagcctgggtgacagagcaagactgtctcaaaaaaaaaaaaaaaaaaaaaaaaaaaaggcaatatttatttctcaccatcaggaatctaataatctaatataaagatcaagacgttatagatgcatctgcaatgtgaatttttaaacttgggtgcatgtgtatggagggtccagaaaaccaaactggcggttttcacagtggccaggtttctgatctcaccttaatttgctccataaggactgcactggttgcctctgtttcccgaagcaggccgtttaactgatctgcactttttgtggtggaactgagcttctgaaccaattcttctttggtaaattcagcatgccataatggaggctctgcaacatgttgttccaagaattaattttcaaaatcatacattacagatgaagattctaaataagaaaaatctaaatataaatatcttactatgtgatattttataggtctgctttctttgccattcatctattcaacatacctcaatcaacagattatatgttgtaggtgacacaaataaaacagtatctctgttgtaaagcatgtaatctaactgaatacaagccctatgagtcccagttctgaaatttgtcagaattgtgtttatagacagttttattacacatcttcttcccatctattaatattccaagattttatgtcatttcacgtataaggaaagcattaacatttactggtcacgtatcatgttccctcataagaatcttctatcaggcggggtaggtatcattattcaaactttacagacgatgaaacaggctcacagttgacaggtaattttttcagaaatcacaaagtcaaattggcttctggagtctgctgctctatcatgatgcctccgtgtcaccactattaactttgcctgaaggaaccatgacttgcagtttctaccccatgtggtcagtgaccatgaatacaaatgacccttactccaggtgattctgaagtttcaggaagatgacagattccccctaaattttgaacagtaatattaattacaggtaataaaatataccaaaacatcactacaaaaatttagcattacttcatcaagaggaataaactgaaactgtcagtttcttggaagggtgagaggatagtttatcctgctttctaatacccaccacctatttgtgactataaacttcccaccacttatttatggttcaagcctagggcaagagctagcattttattttaaaaaagatttgtttaataatttttccatttggacagtgtgatggttaatactgggtgtcaacttgattggattaaaggatgcaaagtattaatcctgagtgttgtctgtgagggtgttgccaaaggagattaacatttgagtcagtgggctggggaaggcagacccacccttaacctggtaggtgccatctaatcagctgccagcgaatataaagcaggcagaaaaacctgaaaaggcgagactggcctagcctcccaacctacatctttctcctgtgctggatgcttcctgcccttgaacatcagactcctagttcttcagttttggaacttggactggctctcgttgctcctcagtctgcagatggcctagtgatcgtgtaaggtaatacttaataagcatccatccatccatctcatccatccatccaaccatccaattagctctgtccctctagagaaccctaatacaaacaggtagtggaatattgaaagaaattttattggagcagcccaaaaaagcatatgtaccttagagtaatagtaattaaataagacagtgaaattaaagaagaagaacatatttagacagagtaacagaccaagtttagtttcgggagaattaagcagctgctctaaagactgtgtgtatgtgctggcggaagacacagactccgtaatcagttgtctccatgccttctccctcttcccgggttacagtgtgcatgtctagaagcgggaggtctgtgtttctcctttctcgaaggttcttcaaagactgctgagaggaaactgggcctattagattttttttaaaggttaagtgtgagattgttcaaaatctattgattcggccttacagagatacacaataaaatgaaaatatcaaatgataagagtagaggaattaagtaactataagtgaaaggtgtatgaagaattgctaaaacatttcctaaaatttagtcatcaaggccaggcgtggtggctcaaatctgtaatcctagcagtttgggaggctaaggtgggtggatcacgaggtcagcaagttcaagaccagcctggccaagatggtgaaaccctatctctactaaaaatacaaaaattagccaggcacggtggcaggtgcctgtaatcccagctgctggggaggctgaggcagagaattgctggaagccaggaggcggaggttgcagtgagccaagatcatgccactgcactccagcctggcgacagagcgagactccagctcaaaaaaacaaacaaacaaacaaaaaaaaacttagtcatcaaacttttaactacgttagtcattttaatagcagctataaattaattgctactagctaagataaactgttagataacacagctcataatatagtactacttattttttattaatttagagtagagggccaaactactgctaaatactggccaaaattaaaagactagattctagcaatttttcaggattaggtatttcagattgcggcatacttcttgaaacacacttgccgaaatctgcttggtagacatcctcaatcactgcccttatacctttacctctgcagcttcttaattgttgctgctcacacctacagtgctcatacagttaagagcccagaatccagggcacagaactaatcaattacgttgcctagcaagactttcctgtttgctgataaactatattttttctgagacagggtctcactctgtcacacaggttggagtgcagtggcacgatcttggctcacagcaacctctgcctcccaggctcaagccatcctcccacctcagccccacaagtagctgggacttccaggtgcatgccatcccgcccagataatttttgtacttttaatagagatgggatttcaccatgttgttcagactggtctcaaactcctggcctcatgtgatccacccgccttggcctcccaaagtgctgagattgcaggggtgagacaccacgcctggtctaaactgtaaagtttatcgggccctttgacatgtattggtttattgactcccaaaaatctgaagttcagagaaatttaatgactttgcccaaggtctcataactgagttagaaaccagaattgtaatctagatttttaaacttcagatttcatttattttgcatttcattaaattgccttagtcctgactgccctttctaaagcattttcctgggtttctggtaagctgactgcttattccactgctgattgctagattacaatctcttgtgcgacctttgccctggctgattacttcctttgttgattctttggcatatgttaaattcttctgaagttgcttttttaccctaataagtgaccgatagctgctaatgctccagtgacaatatttcccatgggaaaccaaaacaccatcaacttgctactaaaatactgcatcatcatggctgacatttttccatttcttcctggaagcagaatggaagatactgggtacggctgaactaaaactccaactaattgtaaatatgaaagcaaagaagctatattggttatgcaattctacacattcagtgctgcttgagtgtttctaagttccttgctctagctaatgtttctatttaaaaagtagacaaatttgatgactaacaacggagaacacgaaacaaatctggtgaataccagaattaagacatgtgtcagccaggcgcagtggctcatgcctgtaatcccagcactttgggaggccgaggcgggtggatcacgaggtcaggagaccgagactatctgagggagaatcttcaggttttttcttctcttttgctgtaacaccagtcaaaaaaattgacaaagataaggtattaagtattgacgttaatactctacctgaaaataaaaaccatggaacctatctataggttaaaacagcatactgataaaaaacacatatactttgatgcagagatgtacgataatcatgaattagaattagcatcctgatttagttttctaccaaaaaccctaagtgaacacagaatctatttaaaacgaaagaaaacaaaaaaatcttgtgtttacttaatagtcattgaaaagaattactacaaatttctagaatttaaaaaggttaaaaattttaaagtgttgcctaactatacttagcatacaatagtttaccaaaatatccatgcatttgcagcaattgaaaaaaatcttaaaacataagcaagtattagtatacatatgaaactaatccaaagccaactgtgattagttcctgtaaggaaagttaacaattgccaagaatggaaggtgactagagttgcatctagtttgcctgtgttcaagcatgatactagataaaattaaataaaaactgttactctatgggtagctaacactataaaatctaagaccattcatatggctgaaaacaacccatccccagccaccatcaatgcaaagggcaaaaaattagaaacagaaaaaacttctatatgcaacctgttctgatctattaatgtaaagaacaacttctggctaaaggagtttaataaagtaagccagttatgaagcatgccatgtataccaactggtgacagggaaacattctgagagctatggtgtccaatatggtagcctagccacattctattaaaacctcacaaggtggctagtccaaatcaagacatgctaacagtaagtgtaaacacacacactggattttgaagacttggtgaaaaacaataatgtaaaatatcattaatttttatattaattagaagttaaaatgatattttggacataatgagttaaatcaaatctatcgataaagttactttcatctgtttccctttttaactgtttctttttattctttttaatatggctactagaaaatttatttatttatgtatttatttgagatgcggtcttgctttgtcacccagagctggagtgcagtgatgtgatcatagttcactgaagcctggaacttgtgggctcaagtgatccctctgcctcagcctcccaagtaactgggattataggcacaagccattgcaccaaatgacaattttaaattacatacacaggttatattttatttctattggatgacactgctctgcagaaccagtgcccttccttttacaatgttaaatttgtccctctccttcattataaacgaaaacctagtatcatttcctagctaggagaaataacagtacaccgtaagatacagattcttgttccacttctgctattactcagtaaagacctcttgggtaaatcagatagcctctcttggcctcagtttactcatgtctaaagtcttcatttctaaggtcccttgggacaatgacattatcagattcaaaacagaataaggctctatgttctacagtagtgtataggcacattcgttcttaggtcagggattcctaacctagagctcacagaaactgtacgcaagtatacatccacttttaagttaacacttttcacatttctcaaagaccgtatctttaaaataaaagattaagagctaccttagctggtaataaaactggtatacttaaaaaaaaatcagagattgttattttatcattgtacttgtttggcatggctaagatgtgttactggtcactaagggtgaggtttcacttccctaacctgttcttgaaggccttcaacagatcccacttcttgttccactctagtagccacacttctaaaaatgatctgtgcaacatatataatatgcaagctgtagaatgctggctgttaaaaatggggtccattttcaaatacaacatttttctaaaccatgcacaaaagaacagccctacagggacactcttccatactgtatacatgccgttgccactacatgtgaatactggcagacgttagtggctaaagataaacattagataaaacataggtcttcactgagcagacctgaaatagcagagcaatgaagtacattacaaatcagcatcccagtacattttaaaaaacaaaccaacaagggtgtcatgccaccagtcaaaaggtactttgcttaaactggcattctttaacattcatgttgtagtggtaagtacttcatttcatacagccacagttattaatactttcctaagggctaccagctgctaaaaactgctgttatctcatactgagaatgctagttctatacctttgctctcaggctgtgaggaaggggtgctagtccaaaaggccatgggattagatttaaaaaggctaaaattaaatcctagaaaataaagaatatttcattttttaacattttaggaaacaaaatgaatatgcttttaaaacataaaaagccagaatccctcaatttataccaccaatctgactgtcttacatattcatttatccctgtagtttcattctttgctcatttaatacatgagcaagactgacatacaacacataaaatgagaacatctcaatatcatggttttttttgtttttttgtttttttttttttttttggagacaaagtctcactcagtcaggctggagtgcagtggcatgatttcagctcactgctacctccatctcctgtgctcaagcgatccacctgcctcaacctcctgagtagctgctaattataggcacgcaccaccacgcccggctcatttttgtattttcagtagaaacagggtttcaccacattggccaggctggtctcgaactcctgagctcaagtgatctgcccacctcaacctcccaaagtgctggcattctaggagtgagccaccgtgcccagcctcaatatcatgttttctgagtgacaaaagaaacagaacaaatgaaaatgaacactttaaaaaaagactcacgttaatgcgcatgattcaagcatgagtccgtacactgtaccaagttcttttgctctgccctagcatgatagaagtatcttccagttactgaaatgtctttaactaagttctcttgctctttgaaacctcaccgtgaacttattaagggagaaaaaaaattgctcaaatattttgggggtgttcacaaagcatcgtttatatcccaacattagtatcccacaaagagtctgcatcaagctaaacattaaaagaaagaaaaattgtgcttaactttaacaacaaagtacctacccttttctggtgttttaaatgtgtagttgattgaagattcttccattggaaaggaagcagagagatttttgactttgctatctgaagactgttcgatatcagagttctttgacagttcacattttttaggttccactttgctttcagatccactctgggctactgaactagtttcactatcgttacttttcaaaggtgcattaaaactaaatccaaacaaagacccagtggcagaactgttgccaaatgcaaatgggtttgatttttcactactaaaaattcttttaacagactctgaaccaaatacaaactttggaggagaaaccactgcttttgttgttgtttcagatgtgctagacacttcaacttctgaagctgcatctgctacatcatcaccctgaataacatctgtcctctctcttgtggtttcttctaatacagctacagcaattttgccacatggtgactctctgggagtgcttgaccgagaaacatgaggtgttatcaaagaatctttttcctgggctgtttttgcttcatcaaaaattttcttaaatgagtctgcaacatcctgtagtttaaaacgaacagctaaatgctctacttttctttctccatctgcaaaatcacatgcagtccacacccatactctttctgtccctttcatattttgcaaactcatgtctggagttattctgtgattggcacaaagttttaatacttggtcccttctcatcactatacgaacttgcttattatcataattctgtaaaatctttatatcaccaatgcccctttctttccattgaccaacatctttatcatatctgtagagttctgccatgtgactaaaaacaacttgttcattttcctcaccactggatacttcaactagatcaggtaaaggaacaacaggttcaaagtactgtccatctctctcttcttcttgagtaacatcagattcttcatcagtgccaactgaagtcccactctgattcaacttggcaggagacttagatagactcaaagcagatttaaaactgaagttaaatcctgttgttgactcatcaaagcggaaaatattttttctcacagggctacttgccaacggagaatcatgtactgagctactactaacattatcatccaaagcatcttcccttaaatcatagttatcccattctaatgtgggcccagtgttttcaggattgggttttattgttgtgtctgaggcaccggctgcacctgtacctgaacccttattttcttcctcagtgacttttgtttgatcatttgtcaaaaacgttttgaaatctttcagtccactcttcatttcttcagctctctgtattagcttggcagctctgccagtatctacaagtttatggggagtttgaagtggtatgtctaacagaagccgctggcattcctcaaatttctgcttgaattcttcagccagctctggtgttttaaattgtgctgccaaccgctctagtttggcatcaccatcagagaaatcactggctaaccacatccatgctctatctgatccagagaggggcttcaggttcattgtagttgttatccaatgattagcacacacttttagtacttggtctcttcgcatcagcattcttggtttgccattgacctcatttttgagaatttttaagttccccaagcccctttctttccactgacttatctcagcatcaaatctaaatagttttaccccctgtgaatacagaactttttcaccttcttctcctgttacaagttctactttttcaggcatttgaactactggttcaaaatggatgtcatcgctgtcctcagtcttacaggcatcatcatctttctcaaagtcaccggaagtgtttgctttattggccattttaccgcattgtgatgagaataatttttctccagcacctgaaaatcccttgaaattggggtcttttttgccaaactgaaatccttctcctgaagttgattttgcaacatctgcaaatgtaaaagtgctacttgtttggccaaaaatcacaccacggccattcttctggccactaatatcctgagcctggaagccagtatcattttcaagaggcttttcacttttcttttcttgatttcctggttccgaaatgccaaatttaaatccatcagcagacacagcgatggaaaatccttctttggttgacttaaattctgtattagaagaaccctgaaacataaatgaaggtgaattttcttgatccacatgcccaaaatagtcatgaaataaataccttcttcattcctaaacaatttatcaaatgatgttaacaataatgatgatgatgatgatgataacatttattgagcatttattaatgtgccagctgggcactgttctaagcactttacattattatctcattttaatatcctcaaaaaccctatgaattaaggtattattattaccctcatttcacatatgaggcaactgatgcattgagaggttaagaaacttgcctgtggtcaaaataagcagaagaacaagggtctaaatgcaccccaacactctgtcctcaaagctgtcacattcaactaccactgtaatattgagtcttcaatcaattgttatatatatagctgtatcaggcctgaaagtacttaccacatagtgggtcagcaagggcattacagttctatttctgttaaaacagaacgatgaaggatccaccaccaccactcccatttttaaaatattctaaatattcacacttattaacacaaaaataaggtgactaagaaggataatttctgtatttggagataaatttaaaatatctacattttaagggacataaaagttttaatagtgaactgctctcttgaatttatttgaaggaaccctaaacaatttaaaaagaaaataattataaatgtataaattattcctttgttacctttgtgggagtaacattagctgctggtctgagaagatactgggaattatatgctggtgactgactataatatactgaagggccagtagttgcaactaaaaaaaaaaaaagaaaagaaagaaaacactgttaaagtctatactacagttaagactatctaggcaagagctataaatacaaaagcaatagaaattaaagaaagatttaactacataaattttaaatttctgtacatcaaaatataccaatcaagattatcaaatgacaaactagaaaaaaattgctaaatatgacatgaagaataagagaatagcatcgctgtgatcaacaagaactacctcacaagcattaaaaaaggaataaaggagaaagtaactgttgccttttctaagaaagatcagtatgatgtggaattatggacattcagtcacagaaaggacgtaaggaaccaagatgccatctgatggtcaatgcatttgaagtgggcctagaaaatctgcagaaagactaggttgtattttgtaaactaaagctattactgagaatgttcagctcaaaaatcacctgacaaattcatggaaaggatgtcataaataacataaaatgtgttccctggcttaaaataaaaagcacatcaacactcatacagatgtacaaactgtctgctccctctgtttggtctgttttaccaggaaacaaaacgactagaaggcacccatgttaatgacaaaactaccaatagtcatttgcttgaactgttttatgatagttttaccagaaaacaaccaaaagaccttttatgcctgtacatggaagaagaaacagaaactgtgccaagaggttccaaacaattgcctctggaaagcactgaaaaatcaagacctagaaaaggctagccagaagcccaagtttgattttggaaaccttacagaggtgaggataactattttgaaattactatggggaggaagcaggcacagaacacagaacaacctgacagaaatggcccaagaatcttaaagtcttgcaaaatgtctgtctgcatgaaagcaaaaagaaaaaataaaatattaaataaaaaaaaaatcttagtctgaagtttaagtagggactttaattgactactgactctaaactgtgaggctctaataaatatactaaaagtaatctaattttttaaagcaccatatgaatagacaatttaggaaagaaatgttaataggcctcaaggaacatgtttttgaagtgagccttgaaaatctgcaaaatgacaaggttgcattgtgcaaattgaagctattatgagaatgttcaagtcaaaaaaattacctgacaaattcatgcacaggatctcacaaggaacacaaatgtgttcgttggctttaaaaaaatcacattaacattcatgttgatatacaaaaactcttctccatctgttttgtgtgagttttaccaagaaaccaaacaactggaaggtacccacgttgaagatggcaaaactaccaactgccatttgcatgaattgttgagcatgactagtattaaaaaaacttaaaaattgatataacttttgttcctacaaattggcaaaggattttataaactagtaagtcagcattagcaaaagtgcgaaaatggcactatcagatactagtggtaagagcataaactgaatattttgaataccctacaaaactaggacagtgtcctagaatttgtaatggcataaaccagaaacaacataaataaaggaacagaatttacagtacttccatgtgatgggacaccatgaactcattaatattcaaaaaacatttaagtttaaaaatgctcagaactaaagtaacatttaaaaaacaggctagctcatctacacacaacatagtaacatggtaacaatctcataaaaaatactatatgtatagagaaagaaccagaaggaaatgctctcaaatataagaaatgttaataaggtggttagtttttagttttcttcaccctgttcagtacttctgagtatctcctatgagctcattaatctttaattttaatcatcttattttaaaaaaacaaggaccatcttgatatatgtttacttttattaaggaaaaagaatctatgaacacaggaacagaaatcaggagatcttggctctcgccctttcagtgccacaaagctgttttgtgaacctgtaaataatccatttggagtctccatgtttctcaattgtaaaatgaggatatgctgcttctacacatttcacagggtcattgcaagaataaaatgagacaatgagaatgttggatttacatgcttgtataagaacagaagaccttttatgcctgtacacagaagaaatggaaatcatgacccacaaggcaccaaataactgactgcacacgtcactaaaaaagccccaggaaaggctagccggtttgtttatcctcttacaaggacctatatgatgtgtaaggttttaagaaaacaaggtttgaacgttagacatttcatatacttatctatgacttacgacatttaataagcttgacttcacaaagattttctgttattttgcttgtgttgagaagatactatcacaaaaggctagtggggttgccttaactataggaaccatcacacaaatgtgctcatctaaactagattttattctaaatctttcctgggctaaaaagagaaaaaaaaaagggcactactactaccatttcagaagtctgtcgtacgtaaaaggaacaatttttttatttctggctgcctgggagcaatgtattatactggcaagtgctttggagttacaccactggagtgtgaatctcggctctatcaataactagctgtataataatgagtaagttacctaacctttctttatccatttccttatttataaaaaagggattaataatggtaccggccattctaagttactgtaattaaatcaaattacattcacaaagcacttttgcacatagccaacccacagtaaacactattagtaaccttagttcattaactgtttactgtatactctaataaatgtctgatacacacccacgcccacctgcacatacacaaatgctcatagtaattatgtaaggcaagtattatctccacatttcagacaggttaacttacacagctattatagtaagtgatagagcagaacttaaaaaccctgtatgattcaggtccaaactccttttctttctttatataaccataatatttcaaattaagtaagatttcctatataacgtcctgcctctcatcattatcatcaaaataattccccagaggtgtaggttcttaattaagcatttcttagtgcataactctattcaataacatttttcaatttaaggaataatctcatctcagctcatctgaggtgtggattaagtgttctttaagcctttatatacacgtgatcacatacggctcgttttttctgcttgggattataaaaatctccgtaacaccaaatacagcttttgaagtcacatataaacagacgttgacatgtatattaacaaacatatataaacaaggtgatttcacacgttatctacttaaaagagggaagtaaagtagttttactaaaatatgcgattatgcacttgccagctcacctgttagtggagccccatgaaatgtctgtgacccctgatatccatcaggcaccgagtctggtccataattctctgtgggccaacgatgacgggatgctgacttactgctatttagtttctattggaagaaaaaaaaatcaaataattttaatcatttaattatatcatgccagaaacagtgctggggaaacttactcttttaaatttaaataactgattttttctttttttcttttttgagatggtgtctcgatctgtcatccaggctggagtgcaatggcacaatcttggctcaccgcaacctccacctcctgggctcaagcaattctcccacctcagcctcccgagtagctgggattacaggcgtcagccagcacacccggctaattttttgtataatagtagagatggggtttcaccatgtttgccaggctagtcttgaactcctgacctcaagtgatccaacacctcagcctcccaaagtgctgggattataggtgtgacccaccacgcccggacctgattatatcttttgaaagtttctatttgccaatgagttctaggtacctggtgctgattttaaaatatgattcttaatttgttaaaaatttatctgctcccattttcattcgttaatacaaaacctaattcattaactctctcacctaaacaaataacctcctaaatgatcacaccttcatttccattctacacttgcctacattaacctttctgacattcacctccagccaagacaattccctgctcaaaaaaacaagtacctacaaactaaacttctttccccaactttcacagtcctctaacattacactgaccatcctttcagtgtgttctttctatactgcaatctggactacctgacattccaaatcacctccccaaattagcttttcacttaaccccatgctgaaacaaaatacaactaattctccaggtgacgttcaaatgctccaccaggaaagggaaaaaagcagtagctgcagataatttattatgtatataataatacgtccaatgcacttaaactcttaatttttatactatctacactgttaggtaaacaatattagctcctatcttaaaatgagagaaagggatgcagggaataacagctggaatttgaaccacatctgactccaaaaatgttctcttaacacaactctgctgccttgacaagatggcagatagatacaatgccgtctagtgtagctatgtggctacctgatctctgctgaagaaaactaaatgacagcaccatacccaaccctagaacctacaaaatgtccccttacaaaacagacacttaacaggaaattctttttccaaagaaattgtagtggtatcagaaaacaggtaaattttgaaaagtttcaaacttctctgtatcagcccaggaatccgaccagttctaacaagtgaggtcagggacagatctagcatgtctgctttctttttctacaagtgtttcaaataaaaatttcccagaaagacctaaccatgaggtccaaaactatctcaattttcaagctaaataaaatttcccccactcatccatctacagtgcctagtccagatgctacacatacacatccaagaaataagaaactagtggaatcacctagaaaactttatggtcactgttggtatccgcaccagagctttgaatttgcaatcactgctgtaactgtaatttttaacattcagtgtaatgagaactggcttcaataattctctcattttaaagataagaagccagtcacgaaggaagtgactggcccaagatcattaattaatggcagagtcagtactagtaccaagcttttcaagctcatggactagtgctccactatacttccacagaatacaatgttgggagcctgaaacctgtatgttaagtcaaaattgtatgtaattgtcataggccatgactacacagaattaacattcaagatttttgtgcaaattcaaaaatgtcttccccaccaaatagtattctcttaatttgcaaatactgctgatcacactgtaataatcgccacacatcagcatatccttgatgtaactttagcagtataatttagttcttgcctgataaacatgaaagaacctacttttatttccaattccaaaaaagtcaagctcctttgaaccctattgttaaaataagatatatatacataactatttccttacataattaagtcaaattcatatggaagtattaaaatatagcaagactttttgaagctcagaccacttttcaattcctagctatacatttgaaacacatgtaatccacagctaatctgagaatgaactcatagaccagagtatgattagtacactgtagcagttcaatcactcgggaaccttctctgtgtcaggaactcttatattttaaataaaacagtttctacctttgaaggtctcaaattttgtggaagatgaggagagagacacataaagtactttcaaaaatatagtaaagggctgggtgtggtggtttacacctgtaatcccagcactttgggaggccaaggcgggcagatcgcctgaggtcagaagttcaaaaccagcctggccaacatggtgaaactctgtgtctactaaaaatacaaaaattagctggtcctggtggcgggtgcctgtaatcccagctactcaggaggctgaggcaggagagtcgcttgaacctgggaggtggaggttgcagtgagccaagatcgcaccattgcactccagactgggcaacagagtgagactccatctcaaaacaaaacaaaacaaaatatggtaaagggtcaagaccaaggtatgtaggctgggcacagtggctcacacctgcaatcccagcactttgggaggctgaagcaggaggattgtttgagccaggagttcaaggccaccctgggcaacatggaaaaatcccatctctacaaaaaatacaattagctgggcctagtggcgtgtgactctctgtagtcctggcttcgtggcaggctaagccaagaggctctcttgagctaggaggtcgaagccacagtaagctgtgatcataccactgtactgcagcctgcacaacaagaccctgtcttaaaaaaaaaaaaaaaaaagaccaaaatgtccccttgccatactatttggatggcaaggggacattctgaccagcttcagaaaaaaagtgagagagtggccagggaaggaatcttggaataaaaagtacagctagagaaattaagtgacttaccgtaatggcctttacttcttggcaaatcattttccgtaaagaattctgatcttctgcccatcgaggtggtgttttgggagaatactaaaaaaaaaaataaaaataacaaaagagcatttaaaacacttagaaacaatttcacaatgaaatgattccattctttcctgtttaccttgtaacttttacttggtgatagtgaatatttggtaggagatggtgtagaatgttttatttctgaatctgcatttcgcaaagaaccatttttatagagaggacctccttcactatagtcttcgagttcctgcatgactgacttaagcatctcttttacagactccaggggcacaggcaactaaaaataaaagacattaattaagggctttcatttgcaaaaaattccaaaagtaaaaactctaaaatgatatattttatcttatttacatttttgtcattttaataagcactttacactttaaataataatacacgtgaaagtgttttttaattatcttttttctttgtttttctgctgttttgtattattatttttatttttttgtctttattctatttttttcttcatgaacacagaaaagtgttgtacaatctaacatcttctgattctaaagtccatgctctttctattacttctgttaaccatgataattgtagaggaatgttaacttggaaagcttttccaagtgaacaaaataagttactgatgttttctaactgattttcaatggtgacagaaatacagatgctacaatacaccagacaacataaatcctaataaaagagtagtaacacaaattaatcaacaaaacactcagaagactgaacataatttaacatcatcatgacaatctcaaacagctgacagcaagaaaacaagggcgttcataatggctgatgaggatgagaagaaatgctcttaagttgtcagcaacaactttcaatttcagcaaagttcattaagaattagtcctgaggttataatatttgttttgattacactgctaagataacacctagattcccaagtttaaaaagacacaccaaacctaagacaaagcaagcaaatataagcatttagacacacacatcccttctgtgcattaataacaacatattactgagtatttttgaaattaccaaaatataagaccaacgcaaaaacactgaccagtgggttatcagtaagaacgtacatacaacaacctgctacttactttcttgaccactgaaagatttgaatcactgtcatctataatctttattaggtagtccctggtctttctcagataatttttgcattcttcttgttcttcaggaaaaacggcatcattttcaatgtcttctgctttcctgtgaaaaatctatacaaatagtgcttttatgaaatcattagctttttaaaacaaaaaactttcagcttggccacgcatggtggctcatgcctgtaatcccagctactcgggagctgaggcacaagaatcgcttgagcctgggaagcagaggttgcagtgagccaagattgtgccactgcactctagcctggccaacagagaaaccccgtcttttaaaagaaataataaataaataaataaaacttttagctcaagtactgcatctacttaccagtgcaagattccaataagaaacaacactttttatagattcaaaagcagtcacagcatcttctatatttccatgtactgcatccaatatagcaaaagttatgtgtgcatcttcttcatactcaacaatttctgatgcctaaacacacagaatagtttttagtcaaattgtttatactcagaatataaaacccaaatgattttccaaagattttatatgatcttaagagacaaacatctcattactcttctctgtcatatcttatctgtgagagctagtgaatttagaaaacaagattaccgttaaataacaaggcaattaatttaagcagtttatagctccacgtctttgtttataaactggaaattcccatctccaataaattcataaaggaactctgttacctgaatgtctacactatgaaaatgtttaaacagaggatcaataggttcaggaatactgttcttctttattatcttcaacaatggcaaaactttcttccaataatgaacacttctccctatgtattcttgttgatcataagaagaattaagacccctgccctaaaaaagaaagttaaaagcacacaactttaaggaacacgcatgattagatctaaagttcatttacaggttgtaagaactggctaaaatttcaagtcaaaaccaaatggtacctcaatagtcatttgttcaacttccaaatactgtaataactaaaccaccttaataccagtgaactcactgcaacctctgccgtgcaggttcaagcaattctcctgcctcagcttcccaagtagctgggattacaggcacctgccaccatgtctggctaattttgtagttttagtagagtttttttttgtatttttagtagagacggggtttcaccgtgttagccaggaatgatctcgatctcctgatcttgtgatctgcccgcctcggcctcctaacgtgctgggattacagatgtgagccaccgcacccggcctctacactcaacttttaaacacttctaatgataccaccctaatgtagcaatcccaactactttttaacagttgccatttttagatagctgaaacctgcctcttctgtagtgtcagtttgttcaaaaggctgaccatcttcacctaatggtgacacaaaacaaaccttaaatatttagaaagatctataatggtcttacctacaaagccttgtgctaatttttttttttaattttcaggctgaataattatcagaacttaattattaaggaataacagtaacagctcagctaatatgtaacattcactgtgtgccaggcattgctcctctaagtgcttatatttaactacattaactattttgcagcaataaaaaacacatctgtcataatatgaccaagctgctgttttctgaacaaaaaaactttcaataaaaagtgcatgattttaaaaaattaaggtaatgttctttaaaaatgcttatactttaaaactcaccattttctgaaggcattttgcccaatgtacaagcagagcaggttgaaggccatgtttttcctgggctcttagagtgtttatttcatgctgaactacaagtctcaattctgctgagtttccaggtctaaaaaatacttcaatttactaaaattgttttctaaatacacagttcagcgcttacatacatatatgttaatgggtcacatgacaaattaaatcttcacatgaggattaaatccccggtaaaacctacgcactaagtgaaagcaatatttttgttttactacttacactgcttttctgtgaatcagagtacaaaccgcatcccaccaagatttttgtctctctgtacaaagccgtttacacacaggaaggggcaggcataacggctgataggagctgtggtgagaattacatttctcctttaattgtaagtggctggtatatactactccaaggagaaatacctgttttatttaaggaaaagttaagttagaaaaaaaaattaaacaaaattcagaatatttaatttgttaaaatctttgcttacttcaagatctaaaatacatattgattcaggtgcatttgtttcaagccttgaggtttcctggggcaaatgatggaaaagctgttttagccattttcggattccaggtaaagcaggcaatgaattccactgtaagccaagccaagtaaggtgctgaagactaccattatgtgcttgaatagcacctgaaataaaataaaaaaattggcttaagggttcgaaatttttctttgtgccattagttttgccaacataaacaattcacattatatatatcttaattatataactgcttttctatatcaaagctggagggaattctatgttaggcaaaatctcatgttcttattaaatgcattctcacttgattatttctagaaattttaataaaaatagtagtgatgaagaatgtttaagtccatcttaaaaaatgacactgactagaactcaataaaccaaaatcaactgacaaaagccaaataaagaacacctaacctaataagaaaccccaaaacaatgggttttcctttaagtcattaaagcaatggaacaccactatattaatccatcggtacagtaaagaaatctgtttttctacaagaaagtcaatattgaaaaggttatgtgcagtcaggagttcgagaccagcctggccagcatggtgaaactccgtctctactaaaaatacaaaaaattagccgagcatggtgtcacatgcctatagtcccagctacttgggaggctgaggcaagacaattgcttgaacctggcaggcggaagttgcagtgagccgagattgcaccactgcgctccagcctgggtgacggagcgagactctgtctcaaaaaaaagaaaagaaaagaaaagaaaaggttatgcgcttctggaagcatgaagaggtataatctttctgtcattttggcaatttgcaagacttaaagatgttcatgtcctttgtctcagtaattctgtttttaggtatctctatggaaataacttgcaatgaagacactttttgttgaagtttttatcagagtatgattattaacagtggaaaagttgagaaaacttggatgcccaataacagaaagttgcaagcaaattatgactacttcataaaaaagattatattgccaataaaagtgatatttatagttttaatacagagactatgggagagaattcatgaaggaagcaagataaatcatacataaacaaccatttagatgaaaaatatggtcagatgcagtggctcatgcctataattccaacacttttgtttttgagacgaagtctcgctctgtcgcccaggctgtagtgcagcagtgtgatcttggctcactgcaacctccacctcccgggttggagcgattctcctgcctcagcctcctgagtagggactacaggcacatgccaccacccccggataatttttgtatttttagtagagatggggtttcaccatgttggccaggatggtctcgaactcctgatctcaggtgatctgcccgcctcggcctcccaaagtgctgggattacagatatgagccactgtgccaggcctaatcccaacactttgcggggcttaggcaggaggatcacttgagcctaggagttggagactagcctgggcaacaaagggagaccctgtctctaccaattaaaaaaaaaattatctgggccgagtggcatgtgcctatggtaccagctactcaggaggctgaggcaagagaatcccttgagcccagaagttcaaggcagcagtgacctacgatcacgccactacactccagcccaggtgacacagcgagaccctgtctcaaaatacaacaaggctggtcgcggtggctcactcctgtaatcccagcactttgggaggccaaggcaggtggatcacctgaggtcaggagtttgagaccagcctgaccaacatgatgaaaccccgtctctactaaaaatacaaaaaattagccgggcgtggtggtgggcatttgtaatcccgctacttgggagactgaggcagtagaattacttgaacccgggaggcagaggttacagtgagccgagatcgcaccactgcactccagcatgggcgacaagagcaaaacttggtctcaaaaacaacaacaacaacaaaaaatacatgccacccctacagcaccacattcaaactccccccagcccaacccacacacaaaaggaatacaggaaaatattaagtcgttatttctgggtaataagattatgggcaatttataataattaagacggagaccatttcctctgaaacatataacttaccaacatcgtatctagccaaatcttcaagctctggttcttgtacatcaatgtttccaatatcatcgctaccaagaaaagatgtatccttagatgactgactagaaaacagagcattatataacacagactgcccgcttttgttggcaaaagtttcaacaacctcttttaaaaaatcttgcttgccacgacttaagtttagcaacatatgccctgaaaaaaaaatttaagttatttccatcactttaaaaatacagattgtatttgctcacgttgtctcatttgtatacccaaaggggaaataacatgattattgcagacctaaccctccaacccaaaaaatacagctggacaacaaaacgggtgcttatgtagcaaatgaaaagagtacaggtttaatattctcagtatctacataagacagcagaagggggaaaaaagacaggaatgtgtatgaaaaatgccaaacatatttgcattttagatgaaaaggtctggatttaagtggccataggagaacagggacaagctcttattctctgatctgatacactgatttctgaacctggctgatcagaatcctcctttaaacagcttttaagaattatttccggctgggcacggtggctcatgcctgtaatcccagcactttgggaggccaagctgggtggataatgaggtcaggagatcaagaccatcctggctaacacagtgaaactccgtctctactaaaaatacaaaaaaaaaaaaaaaaaaattagccggccctggtggcgggcgcctgtagtcccagctactggggaggctgagggaggagaatggcgtgaacccgggaggcggagcttgcagtgagccgagatcacgccactgcactccagcctgggcgacagagtaagactgtctcaggaaaaaaaaaaaaagaattatttccaggccttgttcccagagatttttattccataggtttacagtaagcaatcaaaaaatcatagtcctcggataaaatactgatacatgctataacacagatgaaccttgaaaaccttgctaaatgaaagaagccagtcacaaaagaccacatactacatgattccatttatgtgaaatgttcagaagaggcaaaccggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaagaagaggcaaacctacagagacagattagcggttgccaaggctgagaggtttgggtaaaatggggagtaactgctaataggtaagaaattcctcatggagtgatgaaaatcttctaaaactgactgtggtgacagtggtaatactctatgaacatagtaaaagccactgaactgtacactttaaatgggtgaagcgtatggtacatgaattatatttcaattcaactttttttaaaaaccctcctttgagttaattctgctgggcaattaggtttggttaccactacacagttgtgtctcagcacacttacagaggcaccctcgggatgcccagatcaaagacataaaaaaaaaatacaggcaattttcatctaactgtgacaccatgcaaaggcacttatgagagccctgcaagggtagaaggaaaagagaaaaggaaaaaagtagaaagtcactttaaggactgaaagcctagctcccacaaaaaaagtgggctatggaataaaagagcaatgtgagctttggccaacagcctaactatacaccaaagcttataataactttgatttaatattacatcttgctctttacaaaattcatccaattttatatcaaaactgctccttataggaagcattatgtttcttcagttcactgcttgattcaatggccatctaactaccttaaagtttgtatcttagcaaaatcacaggtaatatgcaacagacctttaggattcatcccaagccaaaaacgggggaaaaaaatccacaaattccaagagcctaatataaggtaagtatatatcttctatcttcctcactatgctctcagctctttaagacagatccgtatcttcttcatctttatatccccacagcagtgtttttagaatcagctggtgttaaatggttggcaaatcaataattatacttagttcaggaagtgactaaatattcaggctagaggctctagcagccagatgaagaaagagttaagaaatcctctccacataggaacaaacaatatcaaatattcattttttttaaagaatgtgctatttcttcgcatctcttccatacctattgctcttaactgatacggcaaaaagaaataattttgacaaattatctcctggacagatgaagattttatcataagatatgccttaacagaaattcctttttctttttaaattaaattagtttaatattactattacctgattggctcagtcggtcacaggccatcatttccagcagattttgtccagcttcaccttttattaatttaatctttggtcttggaacctaataattttagaatcaaaaatcttaatttgatgatacccatacttctaatagtaacatggtcttgtctattacactgtactttttttgataatgaataaacagttaaccattaattaaactgaattggaaaagactgcaaaaactgggaaccaaggaatttatataacctatgaaagataggccaggtacaggcgtggtggctcacacctgtaatcccaacactctgggaggccaaggtgggctgatcacttgaggtcaggagttcgagaccagcctggccaacatggtgaaacccagtctctactaaaaataataaaaaaaaaaacaaagaggcaggcgtggtggcacacacctgttaattccggctacacgggaggctgaggcacaaggatagcttgaacctgggaggcagaggtcgtagcgcgccgagactgcgccattgcactccagcctgggtgaaagagcgagactccatcgcaaaaaaaaaaaaaaagaggggccagacatgttggctcacacctgtaatcccagcactttgggaggccgaggtggggggatcacttgagcccagagttcaagaccagcctgaacaacacggtgagaccctatctctaaaaaaagttttttttattagccaggagtggtggcacacaactgtggtcccagctactcaggaggctgaggcaggaggatcacttaaatccaggaggtcaaggctgcagtgagccatgatcatgccactgtgctccagcttgggtgacagagtgagaccctatctccaaaaaaagaaaaaaaaaaaaaaagcatacacagagcagctctgagaaattagtttctactaaaagcacattcgtgttacattcagagaaatggaaaatttaattatattacttttctgccctgaataaataggacaacagcagatgttgtcctatttgagtagatatgacaccctactttaaaaagtacaggtgaaatgacacttggaaatgccacattgtagataacacattttcagagtatggataacaggggatagcactagaataaatgggacaaccaggaaattaaagagatcctaatgcaataacctatggaaaaaaaaaaagcatgatgaatagaatggcgaagggaagacgtgacagctgccttcaggtattaaaattattttataaaagaaatcatcaaaagaagaaacaagaccaacaggtagaaggcttgaagaatatttttattctatataaggaagtaccaagagccaaaccacctaaagatgcactgggctatcttgaaaagtaatgaatgcccatcactgaaaacgtccagtcacaggcaatgcccacttactagaaacatgccaaaagtaactatatgggtgactagagcatcggcttttaattctatcaccactttcttaattggtggtggaaatgtaatttgatacaacctctttagggttagatatttggcaacagctctaaaaattataaatgcacagatatactttgatactgcaattctttcaggaattcatggcacaagttaatcattgctaaattacttgaagtagcattaaaaaaaaaagtaaaagcaagctaatgtcctggttttaggaccctggttttaaaaactccaaaactacagtacatccatacaatggaataatatgcaagcatccaaactaatgagaatgccctttatatatactgacatggaaacatctccaagatacagttaatggaaataaagtaaatgcaatgttcaaatgttttcctccttcctttaaagacaggggatatatgtgtgtttacttggagatgcataaaacatttcctgaagaacacacaagaaagcaataacattagtttctttggggctggagaaagtaaataactagggaacagaaaggagtcttcatagcatattcttaagagccgccagaattttaaaccatgtatatataattctttccaaacatgctcatttttcaaaatatatgatttatgaacctaaaagcttctgattttgaattttagaaatattcatatcgcctatccttttactcacaagttttctaaacatcatgtcaaagtttgtcatctatatgttgaaaagagcacacaaagtaagaaacaaaatgttgacatcattctttttgttttcaaactgacctcaattcataaacccggcctcttttacaaaattattcaacagttgaatctgtgaccagttaattagttgtgaatccactcaatcaaatcatctcaattcactatttcctcttttttttttgagatggagtctcgctccgtcgccaggctggagtgctgcagtggcacgatctcggctcactgcaatctccgcctcctggtttcaagcaattctcctgtctcggcctctcaagtagctgggactacaggcacctgccaccatgcgtggctaatttttgtatttttagtagagatggggtttgaccatgttggtcaggatggtctcaaactcctgacctcaagcgatccgcccgcctcagcctcccaaagtgctaagattataggtgtgagccaccacgcctggctatttcctcatcttaactaaaaggtttcaagatactttgttaactacctagctgcaatgcagatgcacttactagaaccacagtattcctctgattaagagtctgaaaatcttgccataaaagttagccaattcttaaatacccaaatgccagcacataacctacattttatgcttataatcatttgttcattaagctttaaaataaactgatcaaataaaatacaagcatctaagatgtttctattatatattcattctacagaaatatgtggtagctaataaagactgaggtaggtatctctgtgctgaagtggaacaatgaagaaacattcagaaaagcaaggcatctggcaataggtaaagcacacccacattgaggcacaatattttttaaaagcagagaaagaatgtattgcacatttgcatatgcaaaaaatatttctgaacacccaagaaactcctaacagtagctgtcatctaggaaaggagacctgagtgaatggattaagagggaaactaacttattatgattaaaagttcacagtcaggtgtggtggctcatacctgtaatctcagcactttgggagggcaaggcagaaggatcacttgaagccaggagttcaagaccaaccagcctgggaaacatagcaagaccttgtctttacaaaaaatttaacaatgtagccaggcatggtggcaggcacctgtagtcccagctactgagctgaggctgaagcaggagaggatcacttgagcccaggagttcgaggatgcagtgagctatgatcatgccactgcactccagccagagcaagagtgagactctgcctcccaaaactacatatcgaaaaattttaggctgtgcgcagtagctgacacctataatcccagcactctgggaagctcgagcccagttcaatgttacggtgagctacgattacgcaactgcactccagcctgggtgacacagcaagactctaatagacacacagacagataaattttaaagtttccattaaaaataagaactattggcagggcgcggtggctcacacctgtaatgccagcactttgggaggccaaggtgggcggatcatgaggtcaggagatcgagaccatcctggctaacacggtgaaaccccatctctactgaaaatacaaaaaaattagccaggcgtggtggtgggtgcctgtagtcccagctactcgggaggctgaggcaggagaatggcgtgaacccaggaggcggagcttgcagtgagccgaggtcgtgccactgtgctccagcctgggcgacagagtgtgagactccatctcaaaaaaaaataaaataaataaaaataagaactatcagttacttgagaatttctataagaaccttttaatgtttgtattacctagtgaacctcactaaatccattaattttcactaatccattccttatgaacacagaagtttctactgagccaatattagcatttaacatgtgaactgtctatcaacggtgtttttaaaagatttacaggccaggctcaatggctcatgcctgtaatcccagcactttgagaggccgagtcgggtggatcacgaggtcagaagatcgagaccatcctggctaacatggtgaaaccccatctctattaaaaaatacaaaaaattagccaggcatggtggtgtgtgcctgtaatcccagatacgtgacaggctgaagcaggagaatcacttgaacccaggagacacaggttgcagtgagctgagattgcgccactgcactccagcctggtgacagagcgagactccgtctcaaataaaaataaaaagatttatattaggcagggcatgctggctcactgcctgtaatcccagcactttgagaggccgagacacgcagatcacctgagttcaggagctcaagaccagcctgaccaacatggagaaacctcatctctactgaaaatacaaaattagatgggcgtggtagcgtgtgcctgtaatcccagctactcgggaggctgaagcaggacaatcgcttgaacccgggaggcggaggttgcagtgagccagatggcgccattgcactccagcctgggcaacaagagcaaaactctgtctcaaaaagaaaaaaagatttatattagaaggaggggccttctctaaaagtaatgaatccttttttttccctccccaagcaaaaaatccttctctaaaattaatcatttttctaagcctggtttaatgctttttttggaagactgcttatttcttttcctttcaaaagttatgcaagctcattaaaaaaaaaagtccgggaatggtggctcacgcttgtaaatcccagcactttgggaggccgaggcaggtggatgactaggtcaggagattgagaccatcctggctaacacggtgaaaccccgtctctactaaaaatacaaaaaaattagccaggcatggtggtgggcgcttgtagttccagctactcgggaggctgaggcaggaaaatggtgtgaactcgggaggtggagcttgcagtgagccgagatcgtgccactgcactccagcctgggcgacagagcgagactccgtctcaaaaaaaaaaaaaggccaggcacgccaggcacagtgcctcgggcctgtaatcccagcactttgggagaccaaggcaggtagatcacgaggtcaagagattgcgaccatcctggccaacatggtgaaaccccatctctattaaaaatacaaaaaattagctgggcttggtagcacgggcctgtagtgccagctactcgggaggctgaggcaggagaatcacttgaacccaggaggtggaggctgcagtgagccgagatcacaccactgcactccagcctggcaacagagagagacttggtctcaaaaaaaataaaaaaataaaaaataagaaaaggttttatgttttcaaagattaatagatatactgttacatatacacaatacagccataaatgttatatacatgtgtttcaattaacatgttaaattgcaatcatattcttctatcataggctataaagccattgccctacatctacttattaggattttgtccaagtaacacacctttttgaatcaagctttacccataatacgagattacatctttatcatgttcccaaaaatggcagagtaaaaagatcaaactcttcaaatttgtctacaaacaaatcatggcaatgcaggctttcgacaagagtgcactcaacatccctgtttcaccagcctcaccagtattgtgtatgcttagttattttccactgtatcaaattgactatttcattttaattccacagtttgttcacatattgtcattacataccagagcacaccttcatttaaaacacatcaagactccgtgaaatgtcaattgctcctacaagtggaagacttacctgaaatgctatgacatagcacaatgcagccagctcagaaagagcttgccattgaacattattaccatgctgacccatcttcaagagcagagaaccagcatgcatgtagaaatgtcctttcatttctaagaaagtagctgacagttcatcatttccacccaaagaagattttgcagactgaagagcactatcaaaactgtaatatgaaaatatcaaacagatgatacacacttactgcactgtgaataatcatggttcatttaattcaaaacaaaataaaaattttatttcaagcttcatcttccacattcaacttctaataattcttattccccatgttataaattatgaatcatctaatgcttatttttatcctgcatacttcctatacttcatgcttaacctctcaaatgatgtcttattcccagttatttccagccctccaatcacaggataaatataagattagtgattataggtgcacatttcaaaataaaccaggataaagttgggagactattttgtagtttcttcctgatcatataatttcattatttaattaacagttgtaatttctcaaattagacataccatttccaaattataagtaagtaactgacaggtatttgagtatcaatacagcaattgctctttttactatatagatcattacagcgttaaattgttttttttttttttttttttttttgagacagagtctctcactatcgcctgggctggagtgtaatggcacgatctaagctcactgcaacctccacctcccaggttcaagtgattctcctgactcagcctcctgagtagctgggattacaggcacctgccaccatgccccgctaaactttttttatatttttagtagagacagggttttactatgttggccaggctggtctcgaactcctgacctcacgatccgcccgcctcagcttaccaatgtgctgggattacaggcatgagccactatgcctggcctattatttgtaatctatattctaaattagttcttctaaatcctaatgtttctccaaatcctcactttggaagaaaagtaaaagcaaaaagcaaacacttaaacgtgaagcatgattttaaagtggcttacaataacgcaaccagagcaaatgaggtctaaagatctctgagggtgctcaaaaaccccttcaggggatccatgaagttaaaattacttttacaataataccaaaaaaaaatttatatattacatactcattttctcatgtatgtagagctgagtttttttgtttttgtttttggagacagaatctcactctgtcacaaggctggagtgcagtggcacaatcttggcttaatgcaacctctgactcccaggttcaagcgattcttctgcctcagcctcccgagcagctgggaatataggcgcgtaccaacatgcccggctaattttttgtatttttagtagagacaaggtttcaccattgttagctgggatggtctcgatctcctgacttcgtgatccacccgcctcggcctcccaaagtgctgggattacaggcctgagccaccgcgacccgctgagctgagttttctagaggcttcatgacatgtaatagttttacagactgaaagaggaagtaaatgagaatctagctatgttctattaagcgagacattaaaaagatttacaaaaatgcaaaaacaatgacacttttctgactacttttttgctgttggaaaataattatttttcataaaaaatgctattattggccctgcgcggtggctcacacatgtaattccagcactttgggaggctgaggcgggtgggtcacctgaggtcaggagttcaagaccagcctagccaacatggtgaaaccccatctctactaaaaatacaaaaaattagccaggcgtggtggtgggcacctgtaattccagctacttgggaggctgaggcaggagaatcgcttgaacctgggaagcagaggttgcagtgatccgagatcacactgttgcactctagcctgggcaacaagagcaaactccgtctcaaataaaaaaaaaaaaaaaaaaaaaaaaagctattattattaacacacaatagggcttattacatttttaatggattacattttttatttgttttaatttctaatgtaataaacactgacagaaataacccacatacggccaggtgcagtggctcagacctgcaatcccagcactttggaaggccaaggcaggcggatcacgacgtcaagagattgagaccttccagtactttgggaggccaaggtagacagatcaagaggtcaagagatcgagaccagccgggcgcggtggctcatgcctgtaatcccagcactctgggaggctgaggcaggcggatcacaaggtcaggatatcaagaccatcctggctaacacagtgaaaccccatctctactaaaaatacaaaaaattagctgggtgtggtggcgggcacctgtaggcccagctactcgggaggctgaggcaggagaatggcgtgaaccctggagacagagcttgcagtgagccgagatggcgccactgcactccagcctgggcaacagagcgagactccgtctcaaaaaaaaaaaagatcgagaccatcctggccaacatgatgaaaccctgtttctactaaaaatacaaaaattagccaggtgtgggctgagcgcggtggctcacgcctgtaatcccaacactttgggaggccgaggagggcagatcacgaggtcaggagatcgagaccatcctggctaacagggtgacactccgtctctactaaaaatacaaaaaaattagccgagcgtggtggtgggcgcctgtagtcccagctactcaggaggctgaggcagaagaatggcgtgaacctgggaggttcacaagggggggtaacaaagggcccatgagtcctgattaactgatctgacaaaccatctgtcacccaccaccctaagccacactgtgaaactgcctagggtggcaccagctttttatcttcctcagggtcctcccctcaggcccccaagtcaccccctcatggtccggattctcccctgagtgactccatccccatggtcatctcccctcctgagcctccccctctgagggccaagggctgtcctcagggccctcctggggcttcctggtggggaacaacctgaggcaggaggataagctcttattcagagcattgagaggaaattgtgaagcttgcagtgagccgagattgcgccactctactccaggctgggtgacagagcgagactctgtctcaaaaaaaaaaaaaattagccaggtgtggtgtcgggcacctgtagtcccacctattcaggaggcagagacaagagaatcacttgaacccaggaggcagaggttgcagtgagccgagactgcaccactgcatgccaacctggcgagagcaagactcagtctcaaaaaaaaaaaaagagagattgagaccatcctgaaccccgtctctactaaaaatacaaaaattagctgggcgtggtggtgtgcgcctgtggtcccagctactcaggaggctgaggcaggagaatcgcctgaacccgggaggcggaggttacagtgagtcaaggtcatgccactgcactccagcctggtgacagagcaagactccatctcaaaaaaaaaaaaaaaaacaaaacaaaaaagaaagaaagaaagaaaaaaaggaacccacatacaaagatctttgatgtccttaagaaaaatgtaaaaggaacttgtgaccaaaaaatttgagtatacaaagaacacaaaataaaacatcctacatgttttctaaaataatcttaaagttatgttagttcttttagatactgctcttaccctaccaatttaggacactatgtactttttcaagaaaattacctactccctgcactcagtgaaatgaacttctttccttataccagatggggaaataaattaacttccaaacaaatggacagcctaaactagcaatcagtaaactttttctacaaaaaggaggagattactaatctggctttacaggcatacaatctctgctgcaaccactcaattccaaccttgtagtatgtaagcagccacagacaatacataaacagaggcatgttgcattccaataaatattaacaaaattaggcaggggccatatttggcccacaagttctaaccaacccctgctctaaactaacatttttatacaaatccaagtgatgtttttgttcaatggaatttattttcaaaatggagacactggttttcaaaatcaaaatttaggaaaaaaggtaaatcacatagttgagttattttgtttcttagctaaaacagtattttctgaaataccagtgatgctaagtgcttatactagtacatgtgaacctagccatctgatgacagatgaaccttaattttcactcaagattatactattataaaaaataaaatatgaaatagcagttagaacattcattttaagcttgactatgacaaacctgagtatttaaccataaggctaattttaatcaagcttgaactataagagttctctaaaaaggaaagtcatataaaaccaattagaacttccccgtaaaagaagaaaaataagattgcctcctagtggttcactgtattaactataactcctaggtacattatagaaataatgatgcagtaaagaaatttagagcaatgaacttactgcaaaaagaaaaactacaatttatactaaagcattctcctcaaagtcaacgcacctttccagtaattctctactttcctgcacatctctagtggaaagcgtaagaagcataagattagcataggccagcagtaagtctgtattggttgctcgccagtcacttttatcagactccaaacactgtaaagactccagatattcctattttgtggaatgaatagtaagttacaaaacttaatcaagtgttaagaaattaaccattttatgcctacaaattccttttctcactctaaccacgtttgtgaaactacattgatttttacatcaaccttataaatgaaaacaccaaaaatatatacatttatcatagttatctccccaactttcccattataaatttaactgatcctggtaaaaatttcattttataactgttctacctaaataaaagaaatttaagtcctgcggggcactgctgctttagtacaaaaagatgtatgctaattgcctacatagaaatgtaaagacccaatagcttttatctaccttaagggtctgtacaacacacgaattccactctaaacttgaacgcaaagctatgttcctctctgcctcatggcagcgggccacagcatccttcaatcttttatttgagcgatacaactccactagccggatgttcatatggacgtcatcaggtcttacataaagttctgactgaatccagtcaaaaagtttattccatccatcttcaccttcacaatctagaagatgttcctatttagaggggaaaaagaaaaattattagagtaacacttgtgcaattttaaacaagtcatgctcccaaaaagcaccattccactatgtctagttttatgatgatgccaccaaaaacaccatcctatataccttattcgtcccttctgagagttgcttacaacccagaaactaagcctcaagaactgtatgtgaagaaaagcatctgtgattactgcagtagcttatactctcttcagagactaccaggactattgccacacatccctgtccatctgagtcaccaccagaagcctagacctccccagtcaatcctcagcaacaaggtccttatgctcaaactgctctgtatctccttaaatctgactcaatcccacatcccctctcctcccactgttctgttaccttcatcatcatctcaaagcactgtcatcacctcctgatcttaaatgaagacagtatcatctcaggataacccccactaccatgatggctttttctctctgaacttacatacaaggagaggaagtagggtttgtggccactcgcttctcatttgcgatgctcttccatcagcctctcaagaagctaggaccataggcatgcaccaccatgcccggctaatttttttttaacgttctgtagagatggggtcttgccgtgttgcccaagctgactactcagttccttaatcacctcatctccagtcatgttatcctctactccaacctcaaccatccacttgccactgacacaggtcttcaaaatctgcattttggtcataccaccgaaacgaccataccatccttcttattcttccacctcactgagggcctacgtacccttactttcagaaatatacttctccaccacatgacaagttcccttcaagacaataacatcatcaagttttaagcacctgtaaacacatataaatacacacactttcttctgtcaggcaaaaaatgctataatcccttatatccataattactgtttgcttacagatcccttcaactaattccctcttttcctcagaaccctcccaactggtttctgtgtgcttagatttgggaaatcataaccccaagctaaccgatttcatttgcattatctcaaccatcaaactggtgctgcctaaaacaaaatgccattttagtactaacagactcactttctccactccctgacacttcacacctcctcctatttcctcaacttccccataccttcctttgaccctcactttcaacttataacctagattcatccttcactgagaaacctgatgctatcacatataaattccattttaccttacctacttaaactcgtctttccccagctctcaagaccaagccgtccattactactctgtatttcattcccctctctcctttatcaatttctcctcttctggatgagatggatgataccctggtctctccctattgcaaaagccctagtctttgactctatgttaaacattttttaaaaaaccactatgagtgcttttaaaaagttctatctcatacttgagagaaaaagccttctcaacagtaatactctcattcattaaacaaatgtcagaaactgtttaccttagcaagccttaaattttaggagaaatggaattactttgcatgacaattataaatctcatggatttcaattccaaaaaaaaaaaaaaatctgatacaggaaaggtgttaacagtgccttcaagttattaaagaaaatctttaaagagtgcttcaaagtatctaacttgttacactgcaagaaaacaatctcctgccattacatatgttctttaacactactgacaccagattaactggattgccacgcccaatatgggagttatgtttgaggcataacacctaagagagtaaagaaatctgcacaattagacctcatgttttagactaatatttaaaatccagctgcttattactggggagaaaaacttatcagtaatatttatctttggaagcatcttcaatgctttttcagcttcaaaaatctggacatgattgttcatagcagttgaacaacagccaaaacctagaaataaccaaaatgcccctcaaaagtgaatggttaaggctgggcacagtggctcacacctgtaatcccagcactttgggaggccaaagtgggtggatcacctgagaacccgggaggcagaagttgcagtgagccgagatagcaccactgcactccagcatgggcgacagagcaagactctgtctcaaaaaaataaaaataaaaaaagtgaatggttaaattgtggaccatgaaatgctactcagaagtaaaggaaccaactatggatatacaaaacttaatatggatcacaaatggtattatgctgactgaacaagccaacctcaaaaggtcacatgcttggctgggcgcggtggctcacgcctgtaatcctagcactttgggaggctggggtgggcagatcacatgaggtcaggagttcgagaccagccaggccaacatggtgaaaccccgtttctgcaaaaatacaaaaataagcgggacacggtaacatgtgcctgtagtcccagctacccggaaggctgaggcaggagaattgcttgaacctgggaggcacaggtggcagtgagccgagattgcgccagtgaactccaacctgggcaacagagcgagactccgtctcaaaaacaacgaaaaaagaaaaaaaaaagtcacacatttcatgatgacatttacataacattttgaaatcaccaaagtataaagatggagaacagattaatggttgccagaggtcaggcatagtgaagagaagtaaatagcatgactacaaaaggggcagcatgaggaagatctctgtggtaatagagtagctctgtatcttgacagtagtggtggtatgaatctacacatgataaaatgaaagaaaactatatacatacacattgtaccaatgtcaaaattcctgattttgatattgtgctttggtcgggttaaacaggttgagtatcccctatccaaaatgcttgagaccagaagtatttcagattttgaattttttcagactttggaatatttgcaggatacttagcaggcagagcatcccaaatctgaaaatctgaaatccaaaattttccaatgagcatttctttgagcatcatgtcagtgctcaaaaaatttcagattttggagcatttaggatttcagattttaaatgctcaacctgtataagcattggggaaaaatgaagtagcatataggatctttctgtgcaatctttgcaacttcctgtgcaaaaaaatctataattatttcaaaattaaaattttttaaatttctatcagaaacatatacaatgggggtaggaggaggctaaaggcaaatatacatttataattttatattgtacatacacaataaagtatacattaatatataaaatattacaatatacattttaaatgtttgccaaacatatttgtgtagattttctccagaacagttacttagtaaactatattttgctctataaagaatatcaggaccagtcaatacactagcaagaacttcctaccatttttagtaattacatcttatatactagagaaaccaccttttatcttttccttgaaaactttactatctcaaaatacaatcccttctactttcagaccatagttattagaaaactcttctttaaaatatccctaaattgtcatcctgtaggtaattttcacttaatgaagcaaaaattgtataccagacagaacttaatgtaaatcttagctctacttagtttacagctactaaactgtaaaatccctaaaatattaattattccagaagggtaaatgagatgtcacttataaagtataacaatgcctaataagacagcagatgctcagaaaggttttaatacactttttaaaagaaaaatgttaaaggaaacacaaacacctgggcttaaggtttgctattgaaaagtaatttaaactccaaatattagaaatggttatgtcttaagttttctccctttatgttttgtatgtttacctttagtttataaattgcaggacttcctgggaaaagtttcgctgccctttcaacccagtattttgctcttccatcagtaacatcatttttacaaagcaattctgcaatcttcaacacaagatctttttgtggtgggtttaattccagtgaacgctaatatcagaaaagaaattaaagattagtaaataaattgtatgtatgtatgtaggagtatatatacttatatacttatatataaaggttaaaaattatcactccaacccttaaaaaattctacttctagagaaaacatgttacttcaaaggtgttaaaataaaagtgtcttggaattttctggaaatgaatcaaataaaaattatatttgtgtcatttgaatgcaaaagaacacaaaagaacaccatttctgaccatgttagacttacaatttataggtgttaaacaattctaaatctgttccaagctgtgtcacataattgtactatgataccaatgcctgttttatgatattcataaaatatatttgacttacttatataaatttctctgggcatcatgtgtttggctatgcaaaggctatatttgaatcctataacttaccctgtaacattcaacggctttctctgtgttttcttccaattcataaagaagacccagaaatctgtgagctctgggatccctctcttgcacactaaggtaagtacatacgtatctgtttttcaaaagtaatacaaaagtaaattaaacttagaactgtacttttaaatgctaaccgaagaatacatcttaaaccaaagcaaccactaaactcgtttatattgttactcaaaactaccactatttatgcagataactcagaagtattcatagaaagaaatgggtaatacttaaaaacacgtacatagagttgaccacatactcgttttaccattaaatgtcacatttaccaaatttttctccagtgttatccacgcataagaaatgaacatataaattgctttttcttcctgatcacattttaataaagcactaacagttttgcaaataaattagaagtgattatagtaaacatttttaaagttatcataatgcaaaatactaaacagcaacaatttcccaaacaacaaagggaaatacacctaccctttaagcaagaaagtaatttctaacagtactatatccagctaaaatcgaacagaagacaaattactaattacagtaccaaatacaggaaatttccatttctcaaatcaagtaacaactaaaataagtaaatatcctctaggttccttgacagtattaccatcagagaaattaggccagacccaaactaagggattaaagtctcacagtaaaaaggtacaagagttaacagtcacagtgctgctagttacataatttatgtaccaccattttcctttcttaccagcatttccatcttcctttggatgcctttaaaagcctgcctcccagctgggagcagtaacacacacctgtagtcccaacagtatgggaggccgaggcaggcagactgctgtgctcagaagttcaagactagcctgggcaacatagtgacacctgtctctaccaaaaaatgcaaaccttagccaggtgtggtggtgctcatctgtatccccagctacttggggcgctgaggtgggaagatctcttgagcccagaaggcagaggttacagtgagcaaagatggagccagctgctgcactccagcctgagcaagagagacagatactgactaaaaaaaaaaaaaaaaaaaaaaaaaccctgcctccctcttaatttcctgctttaatccactcccagtcaggaaatcagaatcaccaagcttcttatccctaggatagagccttagagcatcacatattgtgtcaattaaagatcttttatacaagctattctcctgccttacaattacagttttttattcattgctattttccatctgattaaggtatcagatatctaaccaaaaacaaatgaagatataggcatggtcctcttttactccaacagaagacaatttttagaaaaagtgttttaagccaaacaatttcttgcccttggtataaagcagcagcatgcagaaaacactaattacggtttcaatctcaatggaatctaggctggtccttagcatcagtctgagtgataaatcccttattccagaatacacttaggaagaactactaagaacatatttttacctatttcaaagaagaaaatgagaaaaggcattgattttaaaaaaagaatacatgttacagtttgtacttactttttagcaagatcatattctttagcttcataatacagctttgcaaaatagaatcctctcaacttctaaaaaaaattaaaagttgttttacgtttcatacagaaatattttccaacattttttcaaaagtagtaaaaatctgccctaagtttatgttcaaatatgccattttcattcacttaaaagttttttttaaagcctgacaaatgcataattccatgttttataatttcctatcacaaaacaaaaaatagagctgggtgcagcggctcatgcctgtaatcccagcactttgggaggccgaagtgggcggatcacctgaggtcaggagtttgagaccagcctggcgttataacatggtgaaactccgtctctacaaaaatagaaaaattagccaggcatgatggcgggtgcctgtaatcccagctactcgggaggctaaggcacgagaatcagttgaacccaggaggtggaggttgcagtgagccagaggttgcagtcagctgagatcgtgccatcgcactccagcctgggcgacagagactccatctcccaaacatcatcatcatcgtcatcataaataagctgggtgcagttggtcacacctttaattctatttaattctagcactttcagagaccaaggtgggaggctagctttgaggccaagagtttgaaaccagcctgtgcaacacaacaagatcctgtctccagggggaaaaaaatagccaggcatagtggagcatgcctgtgttcctagctactcaggaggccaaggaaggagaatcacttgagcccaggaggttgacactgccgtgagttatgactgtgacactgcactccagcctgggtgacacagggagatcctgtctctaaataataaatacataacatacaaaaaataaattcaagaaagcaagacaagcagacaacagaagttaagaattttcatcagccttggaaatcttggaaaccctgtggtaccactctctcacttaacaaacaaaagaaaccagctttctttggggaggaaaggtattccagaaatctcttctcctaccatgtgtaagcctctatgggaaagaataagtaagtacttacgatctattaaggcactgaggattccctgtgccttaatagtacatgtactgttctctctacagatcagatcagtattttacagtcaaggagtcaaaaaggcagaaataaatattgaattcttcaagtaataaacaaggtccacagcctggctccttggttacgtaaactccaaagtccaaaatgctgatgcacaccaggctgggtgcggtggctcacacctgtaatcccagcactttcggagactgaggcgggtggatcacttgaagccaagagttcgagaccagcctggccaacatgcagaaacctcctttctactaaaaatacaaaaattagctgggcatggtggcacacgcctgtaatccccgctgcttgggaggctgaggcaaagaatcgcctgaacccgggaggcagcagtgggccaagaccgcaccactgcactccagcctgggcaacagaatgattccatctcaaaaaaaaaaaaaaaaaaaaaaaaagctgatacaaccagagtatgttccatccatgtgataaagagtatacagccactcaaacatcttatttttgaaattccaagaccccagtgaatgtccaaaacgatgaacagtatcaaaccaggttgccatcaatcgaaacatgtttcctgtttgtgtcctccacccacaaatttaatgtcttgtccatctcaacaaagcacttatcacacactgtggctgtaacttttgcagtttggggtgtcacaacaaaactagcacaaatttctttttccttcttcacaatttcatggacaaaagatttgttcttaccgtagatcttagcaaccccagtatacgatcttttttctttcctaagtcaaaaactcacctcttcacttaaaggaagcactatatggcttctctctggcatatgtgaactgccagcatcgctattcttgctctttggtgccattttaaataaaataagggttacttgaacacaagcaccgcaatactccaacaactgatctgataactgagatggctagtatgtaactagcgggtggggagcacatacagcatgaatatattggacaaagggatgattcgtgtcctgggtaggacggagcaggaggctgtgagatttttatcatgttattcagaactgtttgcaatttaaaactcatgaaatgtttatttatataatcttccattcaatatttttggaccacgggtgacgcaggtaagtaaaaccacgtaaggcaatactgtggataagaagggactactgtaccagcaacgaacaatcagaaaaggaaattaagaaagcaattccatttacaatcgcatctaaatgaaaaaaatgcctgggaataaatgtaaacaaggaggtgagagacttgtatgcttaaattacaaaacgttgctcaatgccaggctaacacctgcaatcccagcactggcgacagagcaagactccatctcaaaaaaaaaagaactatagcaatcttaacaaaaataatacacaacagtcaggacagcacataaaggaacaaggcttgttccccgcttcctttttttttttgagatggagtcttgctctgtcgccaggctggagtgcggtggctcgatctcagctcactgcaacctctgcgtcccgggtacaagctgggactacaggcgcacgccaccatgcccagctaatttttgtatttttagtagagatggggtttcaccatgttggccagatggtgtcgttctctcgaccttgtaatctgacttcctccgcctccgaaggtgctgggattacaggcctcagccaccgagcccggccagttcccccttttcaaaatgaagaaatagattcaaggtacaatgccaaaacataatagaaaaataattccattaccttctttgcttccaactatgttattaaagtagacaatcttaagataattaaacaactttacaaattattcttctgtatgatcttttgcctctaacctcactttacaagggaactgaagctcaagcaggcaaatgccttgtttaaagatatacagctaggaaggagcacagcccacgttatgtaaacaggacaatatctgattcaagcagtacttctttacatgacagcagatgtcactataagcaaatacctgaattcacttaagctgccaaatatcaagaactgatgcagggctgaaaacaggaacagtaagaccctaagagatgccacatcatcgctatcttgcacagtaagatagagatgtaattgtaattgtccaaaacttaacatttgtggcctactttttcattatgcagttctaaatttctctctctttttttttaattcaaacggagtctcgctctgtcgcccatcttgcacagtcaaatgaatctccctccccctaaaatcctccaaaaaagctgctgttctcaacaaacccatctgatcagctccaaatctgtggagtcccaacaagggtgaaggccgtgattatacaggacaatgaggaaaagtctagatactgaaacatgaattccccagtcttcttcccctggaacataagggtaaggaaatctctcaaaaggcagaacaaacaaaagaggagaataagagaaaaattagagaaactccagctttcaggtaaacatcattaaaaaaaagggtaagaaatggtcaaagaaataatacaagaaacgctacagaactgaaagaaatgagtttcccaattgaaaggacacttccagaaaacctttgttaccaagaacaagactctcatcagactcctaacaacagaacttctggaaaatggagcaatgctttcaaaattgcgaaaaaaattatttcaaactcagaattcgataaccaaatgatcaactaaattaagtaaagatgttttaaagacataccattagtttccagaccagcctgaacagtatggtgaaattccatctctactaaaaatagaaaaaattagccgggcatggtggcgcacacccgtaatcccgctactcgggaggctgaggcaggagaatcacttgaacccgggaggcggaggttgtggtgagctgagaccatgccactgcactccagcctgggcaacagagcaagactctgtcccaaaacaaaaacaaacaaaaaaacctctcatccacttttcctcaaagcaagtgaactatgctacaccaaaacaaagaaagtaaatgaagatgacatgagatacaagaaacaaagggtctaactcagaaaaaagatgaagggaattctcaaactggtgataaagggaagtcccaagagcacagctgtgtagcaaagaggaagaaaaaccaatctgggttggagaagtcggttagtaagggtattccaggtagacagacaatcaatcaatcaatcaatcaatcaatgttttaagctgaaattgatcggattatgtgaccagtttgaccacatttgagggtttaagttgctgagtttaagtaaccaagtagtaacacaacatacaagcaaaccaaaaaataaagcaattattcagtccaggaaaaacaaaactgcacaacaagggcaattcaaatgcaaaatatttaccttatatttatataaatgttaaatattcatttaaacaaaaactccaataacagtactgaaacaatgaggggcaaagcaaagtgtctgaggacagttttggaggagcataatagccagtacagaatgtctaaagtggggccgggcgcggtggctcacgcctgtaatcccggcactttgggaggctgaggcgggcggatcatgaggtcaggagatcgagactatcctggctaacacggtgaaaccccgtctctactaaaaatactaaaaaattagccgggtgttgtggcgggtgcccgtagtcccagctacaggctggggcaggagaatggcgtgaaccccggaggcagagtttgcagtgagccgagatcgcgacactgcactccagcctaggccatagagcgagactctgtctcaaaaaaaaaaaagaaaacaaaatgtctaaaatgggagaaagggaattcaaaataacaaaagtatatgtgtgtgttactcagaagcatgaagtatagatgtaaagggcagaaaaaaaaactaacagctgtcaaaggtgcctgcctgtagtcctaagtactcaggcaacagaggtaggaggatcatttatgcccaaaaatttgatggcagcctggacaacacagcaagaccctattctaaaaaacaaataaataaaaataagagctgtcaagtagagtttgagaagtaggaatcagctgcagaataagaaaccaacttgacagaacatagaaaaactaaacagaagccatctggaaaaagaaaaactagagaaagaattatatatttttttatttttttattttttggagacagagtctcgctctgtcacacaggctggagtgcagtggcgcaatctctgctcaccacaacctctgcctccagggttcaagcaattctcctgtctcagcctaccgagtaggtgggactacaggcgctgccaccacgcccggctcatttttgtatttttaatagagacggattttcaccatgttggtcaggctggtctctctgcctcccaaagtgctcggattacagacgaagaatatttttaagaagggcaaaagcacatgtgagggagtagaaaaatggcaaaacaagagaagattaacaaatgaaagcacaatggaagactagaaagatatgatatacagacgcatcatcacactccaaaactcagacattctagaaagcatgggcagttcacagatggccagcctctgccaaactgggggagaatactaacctctttatattcttcacagccactgcctcttctccctccattccttaccttctatccaaagcaccctgttttgtcatttcactcaaacctaactttacagaatagcttcacatgttccaaagttactcactagttaatccatattccgttgaaatccccaggttctaatgtaaatgactttaaatttgggggaaaaaaaaagactctaagtgtaagagaggtgaggccgaggccgaggccgccgccgccgcccggccaggccgaggccgccgccgccgccgccgccgccgcccggccaggccgaggccgaggccgaggccgccgccgccgccgcccggccaggccgaggccgccgccgccgccgcccggccaggccgaggccgaggccgccgccgccgccgccgccgccgcacattaaccttttaagttaaagattaagagaaccaacacctctttacagtgaaatgccccaactaaatactaccgtatggcccaccataattgcccccatacttcttacactattcctcatcactcagctaaaaatattaaatacaaattaccatctacccccctcaccaaagcccataaaaataaaaaactatagtaaaccctgagaaccaaagtgaacgaaaatctgttcgcttcattcattgcccccacaatcctaggtctgcccgccgcagtactgatcattctatttccccctctattgatccccacctccaaatacctcatcaacaaccgactaattaccacccaacaatgactaatccaactaacctcaaaacaaatgatagccatacacaacactaaagggcgaacctgatctcttatactagtatccttaatcatttttattgccacaactaatcttctcgggctcctacgccgaggccgccgccgccgccgccgccgcccggccaggccgaggccgaggccgccgccgccgccgccgccgccgcccggccaggccgaggccgaggccgaggccgccgtcgccgccgccgccgcccggccgaggccgaggccgaggccgccgcccggccgaggccgaggccgaggccgccgcccggccaggtcgaggccgccgcccggccaggtcgaggccgccgcccggccaggtcgaggccgccgcccggccaggtcgaggccgtcggtctcttcgagatccactcacctttccaggcgacggggcggagccctgcaccgaggcgaggtaccgctccccgtaggctttgctgcgcctcatcgcaccgccaacctggctcccgagacgcgtgaaaccagcgctcagccccgcagcagtcgccaattccaacaggaaagcgcctgaaagccactgacgtagccggcggaggaccactgtgacgcacttgtgtactgcgtcagcactgtgtatccttggcgacgtcggcgctcgagctgcactcggccgggctcttggcagcaccctgtgctctgagggtgtcttgcccgccgggcgccgtggctcacgcctgtaatcccaacactttgggaggccgaggcgggtgctgtaaaccattcatttgcttatttcaatattttcatttgtatgctttcagataagctgaacttgttccaatctgctatacataggtttgtttatatctttacagtaaatatctcagttaagaattattttctctttgtaaagacattgtgactcagatactacttgtaaagtctataggaacacacagctagtaaatggcataattgaaattcaaatggaaatctgattctaaaatatacttgtagcaacatagctgattcctgttactgtatctgctcctgtaaattttgtaaattcattacaatttttaaaatataaaatattttcatatatttatttagtctttgctaccatgaatagcttcaatgggaatgatgattaattctagaatgtgcttgtcttttacatttctatgatttttagggttaaaataaaccttgttggtttacaaatgattcctgaatgatttctttcctctaaatgctacagcacttcactacaaggtctgcaaagaagctatgtgggggagtgaagtaggaggtgactgagattatgtaattaagttcatatatgtcataatttttcattgttcccactgttttagagaaaagtaacaaaggagaagacatgtgggcgtgtagagaaatgcaaggtggagatattaatgctacagtataatcttctgtgggtgtttagcctggggatgagaaaactaaggagaaccatgccagttgtgttgaaatatttgaagagctgtcatgcagaagagagaatagacttttttctgtaggcccagagggtataactaacattaagggaagaaagtcatagggtagaaaaattttattcaatttaaggaataactttctaatagtgcatagtattggaacaggtggctgcataaagtcccacgaagtgttcattctaatgctgaatacccatgcaccaagaatcctgtggaaatgatgcttgcagggattaaagaatgaagtagaatctaatctaatatagcctcttcctactagaatgccaaactcagaaagactttctctctgttctctctttctctctctctcgtgctctctttgtctaatttatctgtatacctatttaatttccaaaaaatgagattgacaggaagtgtaagagttaaaaagaataatgtgtgtatgcgtgtgcatgtgtgtgtgaaaaaatggattttaaaggtattggatgcccgttgagaatgtttatattcctctaccccttgaggtttatggttagcaaaaaaatagtaacaaagataattttgttatatcttattgtatggcagaaggagatttccatagtagaataaaaaaaacttttaaatcagagataacctgggttcaaattccaactttctcactttcagctttttgaccttgaaaaagtaactgaacctttataaaccttcatttttttactataaaatttggataataaagtaccttaactgtagggttactgagaaattaaatgagacaagtcacatgaagcacactttatattgcctagtatgtagacagcaataataaatcctggcttcatatatttccttactttagtttacattgtttttacaaacgtatcacatcagctgatagaattttgatgtcgtcatttaagtttctggttatctggtgtagaatgcaactgtttttctgatttaagataattcaatcaacaaatttttcttgagctccaattttgctcattctacctttctctccatgcaaaaagaaagtgagaaatgtcatttcatttggcaatggttaaacataggcaaacctttagaaatatttctttattttaaaatttgtgcttgtaaaatacttagttataatatatgtttactaatttactgttttttaaagttgttttattacggaaaaacaattttggtgctatacaccccagagaatactttaatgctcaattatctgaaaaaataatctatggtatgctttttcacagccctgctgaattctaggtactcttcctcgaatttgtgtgagaaaatatgtagactcacagtttacttcagaattaaaaatattactacagaatacattcaaattttatacctctgattgcagcatattgaaatgcttaagaagttccattagtgcagatgatgacaactatgtatgcaaaagtaccagagaaattttatgtgtgtttttatgcatgtatctttgtgtatggttacagtatgatcgtggcaaatgtataagatacacacatgttacacttttcatgcctgattaattcataaaaggcatgtgtgtgagtgtatgtatgtgtgtatttgcttatgctcactttctgtgcttgtctaaataatgaagatttttttcctgtatctatgctttcagaaaccatacctgactaactggtggggaatgtgtatttacattttgccactacactaattatttctgattaaattttctagttgcttacgtaaatcatgaattggattctcgtgttaatttgactaaaactaccaactagtaaatattttcaattaagtgattttcttcataattcccatcaatgattctttgttcttgttttttaaagaatattttgattaaaatacaatagtgtcattgtaaaatgattgacaagtataatgaatgaaataaaaatagttgaagatttttaaaccaaaacaaattcagtgataaatgttaatatattttattctagttgtttgtatgtctgtatgtagcagataaaagaaaatctccatgggaattgagatgcaaatgagattgagacatcattaggataaaaatgttagaatcatgaatgtcagaaaaaaaattagtacctggtaaacttgaggaaatctttgtactttccaaagataaaaagaaagttgttgcaaatcaatttatttttattccgaaaagacaaagtgatccagctgatatacagttatagataaatgcatgtacagtcatacagtgtatatcctgatgctttatataatatgtgacagcaagcttgtctttcttctttaataattgttgaaaatttaatttttgtgaccacatggtaattgattacaagaagggactatagtgtgtttatttattcatttcttgaacatttccattgctttctactttaaaattgctttaacagtgctgcagtgaagatacatgtactcaaatattttttaataattctactaattttcattaattatattcctggaaatgcatgtagaaaattaaatgatatagatattttaaatattcttattaccatattacttgattatttttgccacattactttctagaacagttgtgtcaatctgttttcttgttgggaaggtaaaatgcaaacattagatgtctagaacccaataaaaaagacaatgtaaacaagttgtattagtttgttctcacaccattatgaagaaatacctgagacacagtaatttaaaaaaacaaaaaaacagaagtttaatggactcacagttccacatggctggggaggcctcaaaatcacagtggaagggaaaagaggagcaaaggcaagtcttagaaggcagcaggcaagagagtatgtgcagaggaacggccctttataaaaccttcaggtctcatgagacttattcactattgtaagaacagcaagagaaaaaaaacccgctcccatgattcagttgagtcctgtcaggtccatcccatggcatgtagggattatgggaactaaaattcaagatgatatttggttgaggacacagccaaatcatatcattctgcccctcaccccttcctttcaaatctcattttctcacatttcaaaacacaatcatgccttcccaacagtcccccaaaatcttaactgctttcagcattaactcagaagtccacagtccaatgtgtcatctgagaaaaggcaagtctcttcggcctgcaagcctgtaaaatcgaaagcaagctggttacttcctagatacacgggggtgaaggcattgggtaaatacacccaaatgggaaaaaatggcaaaacgaacaggctacaggccacataaaagtccaaaattcagtgaggctgttaaatattaaagctccaaaatgacctcctttgactgaaggtcccacatccaggtcacactgatgcaagaggtaggctcccacagccttgggcagctctgcccctgagactttgcagggtacaggctctctcctgggtactttcacagcattttccacccctgctgaaaacttctgcctggacatccaggcatttccatacatcctctgaaatctatctagagattcccagcaagatcaccatctacatctgagaccacctcagcctggattttattgttcatttcactatcagcattttggtcaaagccatccaacaagtctctaggaagctctaaactttctcacatttttctgtcttcttctgaaccctccaaactctttcaacctctgcctgttacccagttccaaagttgcttccacatttttcagtatcttaatagcagtaccccactctactgataccaattgactgtattagctcattctcatactgctatgaagaaataacaagactgggtaatttataaagaaaaaggtttaaaggactcacagattcacatggctggggaggcctcacaatcatgtcagaaggcaaaggaggaagaaaggcatgttttacatggtggaaagcaagagagcatgtgcaggggaactgccctttataaaaccatcatatctcatgaaacagtcactatcacgagaacagcactggaaaaacccacccccatgattcaattacttcctgcttggtgtctcccatgataaatggggattatgggagttacagttgaagatgagaattggagtgggacaccgtcaaaccatatcacaaatagtagaaaaagacctacagcacattaacatagttgcgttaccacacaggctttaaaattaaagttatttttgcatgaaataaaacacgagaaatatgtttttgcatgaaacaatgaaaatagtcaataaaataatggaaagtatggtaacttaaataattggattcatgagaaataaccaaataaatattctagagattaaaaatgcagtgtctcaaacttaggccatataaaatatgtttaacagcaaacaggacatggcagaagacaaattagtaaaatggaaaagatatcaatggaaaatagtcaatatgaagcacagggcaataatgatttttttttactggacacagtgtaaggaaaatgtgagcacattaaaatatctaacatatatgttgttagaggtacagaaagagaagagagagaaaatagagcagatgtaatatttgaatatgtaataccaaaaattgatagacttcaattgacaaattcaagaatatgagtgaaccccaaccaaaataaaaacaaagagaaccccatgtatatgcttagtcaaattactgtaagctgaagtcaaagtgaaaaaacatatcttaaaaaaatagctgtgatttgggaagagacatacaatgttactttcaaatcagccacagtaatactaacaactagattattttccataagaaatggagccagaagacaatagaaagttattattaaaatactaagtaaaacaaaatcctaataaagagaaagacctaccaacctatgatagtatccctaataaaaatatcactcaaactgaaagctaaataaatcattttcaaacaaaagattgatgagataattcatcagcagaactgctaagtgaatttctcaagctgaaatcaatgatgataccacatgagaagcagaatcacagtaaaaaaaaaatgaagagtattagaagctttaatatataaataattataaaataatattttaataatattgttaacacagaaacaacaaaatcttggtagatttataataaatatgtatataaatatatgacaaatatcacaaaaggcatggaaatggtgcgaatagttatatatgctttgtaaaatttgtgcagttttataaaaatattagtactactaaaaaatggttgattataataactaggaatgcattctgtaacctaaagatgttaataaaaattaataaaagaatgtacaagtaaaacttaatataatagaactaattgtataagaatgatgattaattgaaaataaataaatttaccaaaaacaaagaagaaataatgaaacaagttgcaaaatggttgacttgaacctacctatgttagtaattgttttaaatgtacatgtactaaacactctaattgaaaagcaaactgtcggaacaattagaaaatacaactagatgctgtttaaaaaggacaaatattaactacaacaacacagaaagtctggaagagaaaggacagaaaagatataccacacaatctctaaataaagttactgtaggtaaatataaactatatcaaaatatcagaccatgttgaaagtaacaacttttattctttggaccataaacccacacacagaagaagattattaaaatatgcatttaacaaaagattttatttagaatagataaagaaatcctggaagtcattaaaaacaagataggcaattaaatttaaaactaaatggtaggctggatacagtggctcagtcttgtaaacccagcactttgggaggctgcggtgagagaattgcttgagtctagaagtttgagaccatcctgggcaacatagcgagaacctttctttaaaaaaaaaataaaaattagccaggcttggtggtgtgtactccagaggctgaagtgggaggattactttatcccaggaattcaagactgcagtaaactacgatcatgccactgtactctagactgggtgacagagagtctagtctctgtctataaataaataaataaataaatataacatagtaaaagaacctgaacaagactttcagaaaatgatatgtacatgaccaataagcacataggataatgatcaacgcaactagtcattaatcgaatgaaaatagaatcacaatgagacactactacagacctactgatgactaaaattaaaaagacaaataataccaaatgttgacaaggatgtaaaggaactgacaatcccatattttgccagtggaaatataaattgctgtcagtttttcagaaataattttggctgtttctactatatctaagaatacatacatctggtgagccagcaatttcactccaagagaaatgagttcttaccttcaccatgacatgagcaagaatattcataacagttttatacattatagccataaacataaactgccagttaaacgaggagtttgaggagattttggttgaaaagtacaaagatttagttagaatgatgaataagttccagagcactattgtacagcatggtgactgtagttaatagttaacataatgtatactttaaaattgtttatagagtagatcttacctgccttcaacaccaaaaaataataagtacgtatggtgatggatatgtttattagcttgatcccgtcattcctcactttatacatatataaaaatatcatatatgcttcaaatatatatatagttttttgttaattatagcatagtgaagctgaaacaagataaaataaaatgtgggggagttttaccatatggagaagctggtaatagcacaataacaataataataacagtaataattgttatataacccaaatatttcaaagaatgaatgatagttaaaagctacatatcttatattacaattttagttatactatttatctaaagaagccaaagcttaaatataattaattgatattttaaaaagtaaatacttttatcgggaaatgcagaaaagagagcactttccagctttcagtagaaagccagcattgtcctgacatcaaaatctgatacgtaaattataatagaaaactacagaaaaatgtctgtcatgaatatagatgcaaaaaaatttataaaacattaggatacaaaatccatcaatttataaaatgtatactacatcataaccaagtggattttttacctggaatttaatattggtttaatatttgaaaatcaatcagcgtgattcaccatgaacagagaagcggagaaaaatcagaaaattagaagtgcatttcctttatctgataaataacatctaagaaaaccttcaatttatatcatatttattggtgaaaaactgagctctaaaccggggaagaagaaaaaggtatctgtgcacaccatttgaagtcaaaattgtaatgaaagccataacaagtaagacaaggttgaaaaaatatgcaaggcctcagcctgagaagcaagaattaaagctctccttatatgaagattacatgatcatagatgtagaatatagtaaaaaatgcacagaaaatctactagtgctagcaaatgacttttgcacatattcaggatacagtgtgaatatatagaaaaaatagattttttgcttactagtaacaaacaattggaaagatttaaaatatcactcaaactaacacaatatgaaacaattggatatgaatttaacaaaatacatgcaaaaattatacactgtaacacataaacattgctgagaaaaagttaaaaagccataaatgagtggggaaagatattgtattcatgaatttgaagttccaatattgttaagatgcccatattcataaaatgttacatagatttattgtaatctcacacgaacatgaggatttttaaaaaaatggttaagtggatttgaaacttataagaagcaaaagacctataatgcagaaaaacaattttgaaaaagaagcccaacgttgtaatactaacattagcaaattgaagactcaatatataactgctgtatatgatcaattgattttctgactaaggtgctaaggtaactaagtatggaattaataatatgtcaacaaatagttctgagaaaaacaggacatctgtagataaaaaaatacatatttacatttatctcactccatatacaaaaatgaactggaaatgcatcatagatctaaatataacaaccaaaattaaaagcttttagaaaaaattgtaggaagatgttgctgactttgaggtaggcaaagggttcttagacatataagaacaaattctagtcatagaagaaaaatgatctgatacagctgaaaacgtcactataagaattttataatacaatcagaaatatcaacaagagaaaggaataagcagaggaaagaatctcagtgttcaaaaaaatccgttctttgaatcaactcagtcagacaattataaagaaaaaagaataaaaagaatgattaaaacctctgaaaaatatgggattacgtagacaccaaacctatgactcattggtcattgtgttgtgggaattgagggactagagagaccaatgtgtggaacaggagaattttatttaggtgaccactggctcagtgaactaacatccacaggctgagccctgaacaaagacagggctccacttttatacatgcatctgaaaagggtgtgaaatctgtaaggcgggtaagcaagcttacagaagcagaacaaaggcagtttatcaaccagtgacaggttttacaactcaagccaggtgttgcaactcaggcatatcttgtgaccttcgttgtgctgcacagaagggaaaaacaggaacttacaaaacttgcaaagataattgtgagaatagtaagggggaaagtggaagctgaaagagaaaaacttgtttttcccaaccttgctctgggtttggagggagagactctggagcccattccttcttagccttggctctgcagatagtgctatcaaagcctccacagagccctgcccttccctgggtcttggagtgagtgagcctagtacagaaaaacttgtttttctttttatatcttctgcttcaattggtgtccttgaaagaaagtgagagagagcaaacaacttggaaaacatatttaaggatattgtacacaagattttcatcaacattactatagaggtcaacattcatatccaggaaactcagataacccctgtgagataccatacaggatgaccattcccaagacacatagtccttgatcctccaaggtcaaagaaaaagaaaaaatattagtgggaactagagagaagagacagacaaatagagaaagaaagaaggaaggaaggaagaaagaagaaagaaaggaaagaaagaaagagaaagaaaaagagagagagggaggacggaaggaaggaaggaaggaaaaaaaagaaaagaaaagaaaggaaaacagaaacaaaatatcaggccaacaatggaccattcagcagaaaccctacaagccagaagagactggggacctatattcagcattgttaaagaaaagaaatttcaaccaagaatttaatatctagccaaactacacttcataagtgaaggaaacattaaatatttattagaccaagaaaatgctgagagaatttgttaccaccagagctgccatataagagttccttaagggagtactaaatttggaaacaaaaggccctaaccagctattgcaagaatcattgacaatgtaaatgaacaacacaatcaagtcatcataacaactagcttacaacacaataacagaattaaatccacaggtatcaatattaacatccaatgaaaatggctacatgctccacctaaaaagcacagagtgacaaattgggtaaagcagccaaacataactgtatactgccttcaaaatagccatctgacatgcaatgacacccataagctcaaagtaaagaggtagataataacttatcatcaaacagaaagaaaaatgagcaagggctgctattcttatttcagacaaaacagactttaaaccaacaatcatcaaaaaggacagagaagagcgttacataatgataaaagtttcaattcaaaaatatgtgactattctatctatatatggacccaatacaggagcccccagattcatcaaacaagttcttagagacacacaaatagacagataaccacacggtaaaactgggagacttcaacattccagtaaaggaattagacaaatcatcaaagcagaaaactaacaaagacattcaggacccaaatttgatacttaactaaatagacctaacctctaccaaaccttccacccaacaacaacagaatatacattattctcatctgcacatggcacataccctgaaattgaccacacagtcataaagcaattctcgacaaattcataaaaactgatatcacaccaaccacactctcagaccacagtgcaatataaatagaaatcaatatcaataagatttctgaaaattataaaattacattaaaattaaacaacctgctgctgaattactttgggtaaagaataaaattaaggcagaaatcaagaaattctttgaaactagtgaaaacaaagatacaacgtaccggaatctctggggtgtagcaaaaatagtgttaagaggacagattatgacactaaatgtctacatcaaaaagttagaaagatctaaaattaacaacctaacatgacacctagaagaactagaaaaataagaggcaaccaacacccaatctgccagaagaaaagaaataaccaaaatcagagttgatctgaaggaaattaagaagggaaaaataatgcaaaagatgcaaaaaaccaaaacttggtttcttgaaagaataaataagtttgatacacttctagttagaataatgggaaaaataagaagatttaaatagaaacattcaaaaatgagaagaacacattactactgactatacagaaatacaaaaaaccctcagggacaattacaatcacatctatgcacacaaattagaaaacctagaagaattaaataaattcctggaaacacaaaacctcccaagatttaaccaaatgtaaattaaaaccataaacacacctctaaggagttctaaaattgaatcactaataaaaagctgatcaaccagaagaagcacaagaccagttgaattcacagtcaagtagtactaccagacatataaagaagagctggtattaattctactgaaactgttccaaaaagttgaagaggaggcactcctccctatctcatcccataaagcccacatcattctgatacccacaccagtcaaacacactgcaaaaaaggaaactttaggtcaactttcccaataaacttagatgtaaaattcttcaacacaatacaaacaaagttaatccagcaacacatcaaaaagctaatccaccatgatcaagtaggcatcattcctgggatgcaaagttgggtcaatatatgcaaatcaataaatgtgatgcatcacataaacagaactaaaaccaaaaaccacgtgattatagatgtagaaaagactttcaataaaactgaacttcctttgtgttaaaaacccttgacaaactaggcatcaaaggaagatagcacaaaatactaacagccatctatgacaaacccattgccaacataatactgtacaggtaaaagctagaagcattccctttgagaaccagaattaaacaaggatacccacttttacaactcctattgaacaaagtattggacatcttaggcccattctatttccgcagaagaataatgagatgttcaacaaagctgacgataagaagcaatgggaaaaggattctctattcactaaatggtgctgtgataactggctaaccatatgcagaggattgatactgaattacttcatttccccatatcccaaaatcaactcaagatggattatagacttaaatgtaaaacccaaaactataaaaaccctagaagaaaacctatgaaataccattctggacataggtcctggcaaaggtttcataaaaaaaaatccaaaagctactgcaacaaaaataaaaattgacaagtgaacctaatgaaactaaagagcttctgcacagtaaaagaaaccgtcaacagaaaaaacagacaatctacagaatgacggaaaatatttgcaaactatgcatccaacaaaggtctaatgttcagaatctataagacacttgaacaaattaacaggcaaaaaacaaacaaccccatttaaaaaatgggcaaaggccatgaacagacacttctcaaaagaagacatatatgtggctaacaagcatatgaaaaatgctcaatatcactaatcataagagaaatgcaaatcaaaaccacaatgagataccatctaataacagtcagaatggctattatcaaaaagtcaaaaaataacagattctggtgatgttatagagaaaaccatttgacccagcaatcctattcctgggtatatacccaatggaatataaatagttctaacgtaaagacacatgcactcatatgttcttcacagcactattcacaatgggaaatcaacatagatgcccatcagtggaggactggataaagagaatatggtacatgtacaccatgggatactatgcagccataataaagaagaaaattgtgtcttttgcagcaacatggatggagctggaggccattatcctaaatgaattaatgcagaaaaagaaaccaaataccacatattctcacttataggtagaagttacacaatgagtacacgggaacacaaaacatggaacagtaaataccacagcctacttgaaggtggagggtatgaggagggtgaggattgaaaatccacctactgggtactaggattattatccagatgataaaatgatctatacaccaaaccttcacaggtactcccaaacctaaaataaatgttggaaagaaaaaaaaaacacattattcctcaagagtgtttacacaaatagcacacttactgtaaaagccagaaaatggaaataactgaccaatgaagaaataaattgtggttcatccatatggtgtgtactgaatttaagagtatccccttcaaagttatgtccacccagaaggtgtgaataggatcttatttggatataggatctctgcgtatgtagtcaagttaagatgtggtcatgaaggattagggtaaattctaatccagtgactggtgtccctataagaagagggaaacttcgacaccaatatactcagaggaaaatggctatgtaaagacagaggctgagattagatttatgctgccacaacctgaagaagagcaaggattgatggtaactcccagaggctagaagaggcaagaaagaatattttgatagagcttttggaggcaatatggacttgccatactcattgattttgaacttttattctccaagaactttgagatgataaaattctgttatttttagctgcacagtttgtggtaatttgttatggcagccttagaaagtagtacatagaggatgttacccagaaaaaacataaatgaacccttgatatacaaaacatggatgtattttaaaaaaaaaatttaaaaagaagttgaaatgaaaaatgcatgtagtatgatgtcctttatatacagttttagaaaggtaaaactgttaataagataaaggagaccagtattttcctttgttcagatgtgtgaggaattcactgcaaagagcatgaggtagttttatgagaaaaaaagaaatactcaatatctttttctatatagttattgatgtatatacatttgtcaatataaatcaaattgtacacttaaaatgactgcattttatgctatacaaatcatagctcagtaaagtttattttaaacagaaaagaaatatatgcattgtagaaaacttaaaaatatatttaaaatgatgtttatataattgtattagaaggaaatcactgttaaattttgacacaatcatgttctatcctaactttctcacttgtcacatcaatttcccaaatcaacaagacactttaataggactataactttctaatctgtatgacagttgatatagtttgggtgtcttctctaaatctcatgttgagatgtaatcctcagtattggtgttggggcctggtgagaggtgtgtggatcatgggagcacatccctcatgaatggcctaccaacatttccttggtgatgagtgagtttacacaagatctagttgtttaaaagtatgtggtacatccccccttctctcttgctcctgctctggccttgtgacatccctcctcccgcttcacctttcaccatgagtgaaagctcccttgaggccgactctgaagctgagcagttgctattaatagcaccatgcttgtacaacctgcagaaccctgagtcaattaaacctgttttccttataaattacccagtttcagatattcctttatagcaatgtgagaaaaacctaacaccacagtctcatattacaattatataatttctttaaattttaaatataggtttggtaagctattgattattgccacaatttcagagcctgttattggtctattcagagagtcaacttcttgctggtttagtcttgggagggtgtatccatgaccagatggattcacagtcgaattctaccagaggtacaagaaggaactggtaccattccttctgaaactattccaatcaatagaaaaagagggaatcctccctaactcattttatgaggccagcatcatcctgataccaaagccgggcagagacacaacaaaaaaagagaatttagaccaatatccttgatgaatattgatgcaaaaatcctcaataaaatactggcaaactgaatccagcagcacatcaaaaagcttatccaccatgatcaagtaggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccaatatcatactgaatgggccaaaactggaagcattccctttgaaaactggcacaagacagggatgccctctctcaccactcttattcaacatagtgttggaagttgtggccagggcaattaggcaggagaaggaaataaagggtattcaattaggaaaataggaagtcaaattgtccctgtttgcagatgacatgactgtatatctagaaaaccacatcgtctcagcccaaaatctccgtaagctgataagcaacttcagcaaagtctcaggatacaaaatcaatgtataaaaatcgcaagcattcttatacaccaataacagataaacagagagccaaatcatgagtgaactcccattcacaattgcttcaaaggcaataaaatacctaggaatctaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatgtatagattcaatgccatccccatcaagctaccaatgactttcttcacagaattggaaaaaactactttaaagttcatatggaaccaaaaaagagcccgcatcgccaagttaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctcatcttggacaaacctgagaaaaacaagcaatggggaaaggattccctatttaataaatggtgctgggaaaactggctagccatatgtagaaagctgaaactggatcccttccttacaccttatataaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacagtgaactcaaacaaatttacaagaaaaaaacaaacaaccccatcaaaaagtgagcgaaggacatgaacagacacttctcaaaagaagacatttatgcagccaaaaaacacatgaaaaaatgctcaccatcactagccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaacccttgtggaagtcagtgtggcaattcctcaggaatctagaactagaaataccatttaacccagccatcccattactgggtatatacccaaaggactataaaacatgctgctataaagacacatgcagacgtatgtttattgtggcactattcacaatagcaaagacttggaaccaacccaaatgtccaacaatgatagactggattaagaaaaggtggaacatatacaccatggaatactatgcagccataaaaaatgatgagttcatgtcctttgtagggacatggatgaaattggaaatcatcattctcagtaaactgttgcaagaacaaaaaaccaaacaccgcatattctcactcataggtgggaattgaacaatgagaacacatggacacaggaaggggaacatcacactctggggactgttgtggggtgtggggagggcggagcgatagctttaggagatatacctaatgctaaatgacgagttaatgggtgcagcacaccagcatggcacatggatacatatgtaactaacctgcacattgtgcacatgtaccctaaaacttaaagtataataataataaaataaaaaaataaaattttaaatataggtttttaatagtttttgctttaaattattcaattcaattttacttattctgatacacggtttcagaataaaaataattattaatagtgttttgcagttatgatatttttaattttataattatttaaaagtaccttttcttatctatttacacatattcttgattgtttagatattataatgtagtcaaggactcggtacatctaggctgatagcaaaacattcactcttgttctgatttgcctattatatatttcagtgatgattcatgaaggttttcttgtttttactttttaaaataatttcacgtaattttaggtgacagaataatttttatgtttcgaaattaataaaggtgaattaatgtcatgtggagatacattatatatatatattcaagtgaattcgtccagaaagatggaattttaaatttccatttcttaagtctctcagtaatttctaaaatttcttaagatattatctatgttatttgtattaattttttattttattttacaatttcattgtttcttcaaatatatatttctattatattttctaacctgtaatatctcatttataaggaaattattgattttgtatatttagtttataatcatccagtttacttctattacttgcagtattttgtagttgcctcttttgcattttctatttttctaatcatagcaccttaaaataacgattattttgtcatcaattttcaaataggtaaattactgattcttttcttattgtctgagcaatacactcagactagtattaaataatcctgatgacagtgcatattatttcttgtcttttattccaatgaaaataatgttggctcttaggttatggtaaacttgcactgtggctaagagtatgtcctatggagaaattctgcatttcctagttgaactttcagtgactcaaactcctgagcctttttcttcatttgaaataaagaagctgatagtgccttatcttatagagttattgtaaggattaaatgaggtaacaaatgtaaaatgtttactacggtggccaacatattctaagggctcaatgttagtaacatcaggtatgaatgctaaattaaatgtctttctgtggacatttcttctgtggagctatttttttctcattctatttatgttatagataaaatatgatttagtatagtaacatattcataaaagaaaatataaagctattttttcattgatgaaacaataatttcctcaccacagaatagcatcattttatacacaaatgagtttgatttgctagggggggtttgttgaaaatatattttaaattagcatgtgcatgatcaggctgtacaactttgtgttattatctataaggtcatggtattagttttaaactagcttagcaaaatataaatcttagttatttttataagtgacagaagagtttatacagcatattaattatccgatcttgaaattttaaataaattctctgtaaaaccaaatgaaactagtgctatatttttagtaatgctttattaccttttttaatattttccattgtcattgtttctttcaagacttttgctttaagataattttattttgcatagaaacttatactttaaattagaaattatacttattagcatattttattgacagtattatcttataattttaaaatatctttattgtgattttattttcttaatgattaaaatttgatttatgttcgagttctcttcttgattacaatttcaaaatacttttcttatcattcattttttcttatacattttataaacagtacattatattgtgcatagtgttttgtatactgcttttgatcaattaagttctttaaacaccattaattttacttgtatatcataattttcctatatgtggtgtttttttggggtaatagcctcattggtatataattcacataccatacaattcacttatttaaggagtacaattcaatggcttttaggatgtatacgaaggtaagaaaccattaatacaaccaatttcaggagattttcattactcttaaataaacatccacactcattatttcaatgcttgcataccattgaattatgcaggcacagtgtggttactaaaatattctcaattattgaacaattagattatttatacattatgatattgttcccaatacatagacatgataaatattggatgtgatgtgaaccccaaatacattgacttgatcattacacattctatgttggtaaaaaatatcacatgcatcctataaatatgtataaatatttctcaacaattttttgaattaaatattctgatgaacattcctgcagccaaactttgtgtaagaacgctatgagcatacgtgcaaaaactaccagatatataccaaaagccttaaacatctggtaacttttcatggagaaataccttccttctagatcattcaaccatggctattagcattttttaaatggtaaacattagaaaagtcatgttatatttgtatattattttgccttccttcaggtgataccaagtggaatattttttatattttgattagctgttgtggtttattttctgcctcagaagtatattaaaagttttttgtttttgtccttttcagtttttgaaaataaccatgtcttttgtaactgttttgtatcttatttcagttgctgctctgtcttctttttttaattaaggcaatattagccttatttttccgtgtttttaatgacaatgcagttgtgtttttacttttttagaaatgatattcctagtttcttaggaacttgtttttcatcaacagtggtaattcatcaaattggtaatgaaatttatcaactgaatttttagtatctttccagattaccattgattttacttgatgatatatgttattacatttattgatgttaagccactttgcatgttaagcgtaaaacctttttctaaccaacttatatttggatgacataccattgtgttttattttctagaattctcatatctatattcaaatctcattgcagtttttgtgttatatttctgttttttaatatacaggtatttcttgcttggcaaagtgattagcatgttttgatattttttctattgtaggagagtttggtttagaattcataatttcttgaaagtatggagatatttcagtgtaaagttgtctggcttttcagattattttgagctaagtatttgacataattgttttttaattttttttttttttttttgagacgaagtctcactctgtcaccaggctggagtgcagtggcgcaatctcgactcactgtaacctccgcgtccagggttcaagtgattctcctgcctcagcctcccgagtagctgggaccacaggtgcatgccatcacgcccagctaatttttgtatttttagtagagacaggatttcaccctgttggccaggatggtctcgatctcttgatcttgtgatccgactgcctcaacctcccaaaatgctgagattacaggtgtgagccaccgcgcccggtcctatctgagataattttgattttaattttaattcttttgaacttctattttagataggagggtatatgtacacgctcattacatggttgcattgcacccagatagtgagcatggtatccaacaggtagtttttcgacccatgacgtcttcctcttccctctaaaagtccacagtgtctattgttcccatgtcataatttttatttttttcataagtataggttgattcacagtttagaagttttctattttttgttttgacatcctgtggtttcctagaaaataagtcatattttctagatttccaaattcattagcaaggagtaatacatattttctcatacaatcaatagttattaatacagcttcttgctattcctgatttatttgtattttattatacattatccattaagcatgacagaggttgctgtagtttgtcttttgaaccaatttatagctttaaaaataaattaaaatatattactattgtacaaattgttaattcatagtttcattatttttatttacttaaaagtacagattattttcattatttctcagtaaaaaatgtagtgatgctacatgatgaatttaattttggcagtttcggctgtagtccatgttttagtgaaaatctttgttttataatcctcttgatatatatttagaatcagtttggaatgaacatatgactgattgagaaatgaattctggaggaatgaaaccaaagaatacacgttattcagtatcatatatattttcatttgtggttaattggtacgattccaataacttcagagctagagaatgtaaaaataatattgcagtgttacacaatcaaattgagatggcatgaggattaaaatctttatgataaaaacacaaacacagaaacaactctggcttcatttttatgtcatgtgtcttaacctggggtttaataacctaaaaaataaatctggataccacatcaaagggctttcaacgagctctacaaaatgacatcctggccaaaattagaggttttggtttaaaaagggtggaaaataattgagggtgtggtgtgtgtgtgtgtgtgtgtgtgtgtgcaaatagataaatataagccctttcttttattttggtatcaatgctagtcctaggatactttctcagagacctatgacaaagtaactttggaagtttaatcatttcttacaaattattttttcagaaaattgacgtttgagttacaaaaaaacattaaacattgctctagtaacagcatgtatattgtcttcacaaaatatttaatgccaaaacgataatttatggagagaaaaattgtattttcttccaagcatgtgtagtgagtgtttcaaaggtaatcatgaagcataagataaactaagaaaaatgcatatactgataatgtatttatataggaaataaataatgataatacaaatttacaaagctgagaaaattaagggaatgaattgtgtctgtttttatttgaaaagactattatagttagttgagatgtaagggttgaaatatgattgctatgattcttatacttatcagaataattttacagatgacatagcatacaattactagtataattactactcactccaggaaataattgaagtcatttattaattttgagattttttttccttttttccaaaacattatcataagagtttttccatctttatatggacaagtgtattcagatttttctcgtttttcagataggaataatatgtgctaggcacacaactgataacaacaacaaaaaaataaaaacatgacaacaggactagagtatatctacccatgtgtacaaatgtgcctgtgatatgaagggtgaagtatttgccaaccaaatggtaacttgccttctaaactagattcctttcaaatccaatacttcccctttatactgacatgttggttacctacattcagaggaatattgtatatagtcatacaactagtattagtcagtcagcatgctaattataatacaatcatctatgtggtgaaaactgctgatgtaacatattcagctctgtccacgtggggctttcatgcttttgggtttgatgttccctacatctaaaatgtcctggaatcgacaaactagccttagaataatttctcatctttcaaatctgactttacgtgccgtttcacctgtgaagaatttaaattttttggccaatcttaatttgccaaagaaaattgactatgctctctccttagtcttcaactgtgccctggcatggctaaaacttaattgaacgtacttatttttgtaatgataaatcctttgaagtcaaatgccatgttcacttgtttcgattcaacattcccaacacattatctcaaatattatttattgattgaataaacgattaaatgaataaatgtattaatgaatgaatagaaatcaacaagtcaattaagttaataagctggtcagatttgtcacttacacctcaaccacctcaaagaaattggctattaccttcaaaagatgaaatatgagcttctttggaagttacacgagaaaacagcatacttggttgttttcttaggaatgtgtcacaatcatttcattatgacaccaacaacatcaaattgggctctcaatttgcatttaagggattgacaaaactaggtgtattacaaagcttcgcatgttggctgagttgtaaggactcaaaaacaataaatgggttcctaacatgaatttaccgtaagacccagaaacttctcctctttggttaataaccaaacaaagcaaaatgaggtattcaaactaatccctctacatgaataattatagcagcactgttcacaatagccaaagggggaaaacaacgcaaatgtccatcatcaactgataaatgaaaaaacaaataatgaatttcatacaatatcatgttgtatagcgatgaaaagaaatgaagtactgatacatgctacactatgaatcttcaaaatattgtgctaaaggaaaaaagccagacacaagaggtcccatattgtatgtttttatttatatgaaatttaaagaataggcaaatctgtagagacagacacagaaagcaggttgatggttgtcaggggctgaaagaaatggctgcttactgtgaacagagtctatttagggttgttaaacaattgttagaactagataaaagtggtggtcatacagaattgtgaatatactaaatgccactaaattgtatactttaatacagttaattttatgttatgcgaatttcaccttgattaaaaaaatacagatggccgggcgtggtggctcccgcctgtaatcccagcactttgggagcccgaggcaggtcgttcatgaggtcaggagtttgagaccagcctggccaatatggtgaaaccctgcctctactaaaaatacaaaaattagccaggcttcgtggcacacacctaaaatcccagctacttgggaggctgaggcagaagaatcgcttgaacccgggaggtggaggttgcagtgacctgagactgtgccactgtactccagcctggtccacagagtgagactccatctcaaaaaaacaaaaaacaggccaggcgcggtggctcacgcctgtaatcctagcactttgggaggtcgaagcaggtggatcacctgaggtcgagagtccagaccagcctggccaacatggtgaaaccccatttctactaaaaatataaaaattagctgggcgtggtggcgtgtgcctgtaatcccagctacctgggaggctgaggcaggagaattgctggaacccaggaggtggaggctgcagtgagctgagattgggccactgcactccagcctgggtgacagagtgagactacatctcaaaaaaaaaacaaaacaataacaacaacaacagcaacaaaaaaccatagatgtggctataggggaaaaatcaatgaatatgaggatacaatgaactcatatgggattaattgatgttatttctcttttctttattcactttactaaattcatgtttttgtctaatcttctaagaatcatgagaattgatctaagagtttactgattagaaaattttcccaaaaggaaaaaagatacttatgtctttgttttaggagtagcttctgcttagaaaataaatgtgaatttattacttaggtgtcagagtgtttattttaattaggaaagaacctgtctgtctctgaacactgtacagcttctttttaaaaagccaaaattaattacatatgccactgtcataatacgtaatataacctattgactctagaatttgagttgttagctctgtcttataaataaatataattttattgctcaatgctttttaaagtgtgaaaggggccattgatgtcatattgaaaatgcctataagatgcttttacatctgcaatctacaaagagacattgataatgggaccataaaagaatacttgtgaagctagtccttagtgccactgactttttgcagtagttgtgagcatggttctatgaaggatttgatatatgttgttgcttaagtagaagggtccatgtttcacttggaattaattcagccctttctcttacagaggagcctctgcttctgttctgctctaatgacagcattctcattagaaagcccagaggggttctttaaaaatgtaaatgagatcacattactgggactaccctcaaaaccctccagacttcccatttattggacagaaaagtttaaaattcttacagtggcttgcaaagccttttgcctctgacctcatcttctattgctctgtgttccagagattttggcctctatgctattgattgtgtatactaaacatgctcccatctcaaggttgtcacatttgctgtttctactgcgcagaatgttcttctagatatatttgcataactcagtctcttaatttcttcaagtctctgatggcatgtcaccttattatgggcgttttccctaactattttatttaaaaacagcaaattctccagcacttcctatttgttattgttttattttctccataatagtcatagccatctgacatattacgtattacaaattttttacatttattgtctgattccctcatctagaatatcagctacataaagccagaaatatttttgtctgttttgttcactgctgtattacaagcacccagaaataggcctgcccttagtaggcacttagtaaatactggttgagttaatgacctgctcggtaagtggtgattcattcaatctaaagagtctgatgattcattcctgcctgtctttagttatgagtaatatttttgcccctggtaacttcctctctgtaatttctttttgaaattcctattagtcacatttatccaatatgttgtcacttttttttttgtcttttgactctatttttttaagagacagcatcttactctatcacccaggctgaaatgcagtggtgcattcacagctcaccatggcctggaactctcacgctcaactgttcctcctgcctcagcctcctgagtaactaggactacctgtgtgtgccaccacccctggcaattttttttaaatttttgtagagacaggatcttgcgatgttgtccagaatggtcttgaactcctagcctcaagcggtcctctcaccttggcctcccaaagcactgggattacatgttgaaccaccacacctggccttttaactctattttcaagagatattcttgattatatattttattctttctaatgacttccaacttttaattggtgatgtttaatttctatacattctcatttgttctattacatttgcttttatataaaatcctgtccctttttattgatgaaattggtatcatcccaaatatacttgagtagcctaattatattttgctttcatacttcttccttgaattgtatgtatttctcctagtgtaaaatattcaatttaatccttatgctctttctattttgtacaatttttttcaaatatgggtttatctttgatggttagtcattttgtaaaaatcaaggcctaggctgactatttgtagagcagattgtttccctaataggtgccttccttatctgaaagggaagagttctgtgtaattgagtaagtattgtagcctactcaacttttcttaattgtgcattggaggattggtgaataaccaactcactctgtttcttatcacttcataattaattgaaacagaatcgtgtgtgctgaaaaccttccaatgagcctaactttcccaggctgaacatattattattattgttattattattttgagacagagtctagcactgttgcccagggctggagtgcaatggcgtgatctcagctcactgcaacctctgcctcccgggttcaagcgattctcctgcctcagcctcctgagaagctgggactacaggtgcgtgccaccacgcccagctaatttttgtatttttagtagagacatagtttcactatgttagccaggctggccttgaactcctgacctcgtgattcgcccgcctcagcctcccaaactgctgggattacaggtgtgagccactgggcccggtcatgaacacattatttctttagagaacagtcttttggtagtaagcactgggatgcttctgtataaaccggaatggcaagtggccagtgtggtcagatgcagccattccttttatgttcctttaaatattcaccttctgtgttggtacttccacctgcacatcttccagttctgactgtctggtattccagagctgtgttaggaggattggcttccacctcaactgtcagtagcactttcagactggcttctttcacttaacaatatgcatttaagattgttccatattttttcatggcttgatagcacatccctttttatcactaaagtattctaccgtatgaatgcaccacagtttgtttattcacctattgaaggacatgttggttgtttccaagttttacaaatataaataaagctgttgtaaaaattcctgtgcagttatttcccagctttattgagatattaattgacaaataaaaattgtacgtattcaagttgtatgtgatgatttgatatacatatgcattgtgtcatgatcactacaatcaaattaatcaacacttccataaccacacataggtatgctgtccgtgtgtgtgtgtgtgcgtgtgtgtgtgtataaggaggtgaggaaacctaagatctactctctcttagcaaatttcaagtatacgatatgatattatcaactctagtcaccatgctataaattacatcctcagaacttcttcatcttatacctgaaattgtgtacccttttaccattatctccacatttcccttaggctttcaggtttttgtgtggacaaacgttttccactcatttgtgtaaatatcaagaagtgtgaattattgaattgtatggtagcgctatgtttagttttgtaagtaactgacaaaatgtcttccaaagtggctatgccatcttggattcccaccaacgatgattgagagctcctgttgctctaaatccttgtgttttaatacaattttgtaaaagtattatagtccaagaatacgaaatgtgcccaatatagaaaattcaaatttatccctaatcctattaaaaaaactattttctgctactatgtgtgtatttatatatacacagtcatacagtgtatatatgtttgctttctgcctttttcatttaaagacacatcatcaaagaataccatgtttttgcacactcttcagaagagcacttttttttgggggggtgggcaggcagggagatggagcctggctctgttccccgggctggagtgcagtggcgtgatatcgactcactgaaacctctgcctttcaggttcaagcaattctcctgcttcagcctcctgagtagctgggactacaggcgcacgcttccatgcccagctaactttttgtattttagtatagacagggtttcgcggtgttgtccggctggtctcaaacccctgagctcaggcaacccgcccaccttggcctcccaaagtgctaggattacaggtgtgagccaccacgcctggctggggtagaagagcacttataatggtagattaattctgcattatttggatttgctacaattgaatagctatttctccattgtttggaattaatgtggtttttaattacctcatcataaataacaatgagatcaatgtacttgggcctgttagagtcctccatctaaaaattggttggatttcagaatatgctcaagtgcttagcacttttaagttttgaaagcaggaaataaatgttaaattaacatttaggaagttagaaaaggcccaaaatgaggatcacggaaaacccatatatgatacctactttgacccggtattctaagcacgtaattggtattaactcaagtaatgctcacaagaatctgaggagactttgaagcattattagcccaattttacagctaatgaagttgagtttaagtaacttgcttaaggcattgtacctagcaagcatgggattgatgattcaaatctatacagcctggctctaagcaatggtcttcacagtttcactccattgttgagagaacatttgacttgcatgatttaaggtagaataaaaatcttgatagggccatatagatctcattatgtcctctagtcttacatatggtctattgtctctttagattacctgtcctacatgtagaggcatttgagtttgcagccccatggcaaagtaatgaaaaacctattggttatgaggtcactagtgcagcctaacaaagacatggcccagctgcttatgttgcaagtgttggaaaactgatcaattttctaacatcacttccctaaaaatacattttggtgtgtggatgaataatgctgaataaataccagatagctatgtatactcacagttctgaaaatacatgatccccaacacaattttagttgtgccttggtgcagacgaattttttcacttttatttctctgagaaactattttaaacccacaccaacctcattaatttccacatcaaacaatagggctttgactatcagcagatgtttatactatctgttagccataaaaatttaggacactactcaaattgtaggtaacaaactaatggctctttttgcttgtcattatccaacatttttgttgaaagacccaaagtcaaagaggatggtccatgaactaaatgaattacaaatccatctaaggccaaaacagaagaatgtaattttaaagatactgagcctatgcttttacaacctgaactccctacaaaaatgtgaattcttatgaaagacaaataaaaatttattttcatagcatagattaggaaaattatgcacattttatagattatagacaaattaatatccactttataataggttatggcttactaaataagtaatgtttaatttaaaaattcaaattgtaaatactcaataatatttaaaatatttgtatactttttttttttgagacggagtctcgctctgttgcccaggctggggtgcagtggtgcaatctcagctcactgaaagctctgcctcccaggttcacgccattctcctgcctcagcctcttgagtagctgggactacaggcgcccgcctccacgcctggctaattttttgtatttttagtagagacggggtttcaccgtgttagccaggatggtctcgatctcctgaccttgtgatccgcccgcctcggcctcccaaagtgagccaccgcgcctggcccaaaatattcgtatacttaaaatagtagtcgaggctaggcgcggtgtctcacgcctgtaatctcagcactttgggaggccaaggtgggctgatcacaaagtcaggagattgagaccatcctggccaacacggtgaaaccccatctctactaaaaaaaaaaaaaaaaaaaaaaattagcatgttttatgactttgtttatgttctggttgcatatgtacattcactttaagaaagttattctagctttacacttatgagtcttgtacttttctgagtagatactgtatgtagttcaataaaaatatacttcaaacaatatatttctaagggaaaagagttctgaaatataacataaccattttgacatactaaaatatatactccatgaagcattacgttaactgcaatatagacacacacacacacatatatatgtatacacatatatatgtatttccatgtgtagatataaattgacataatctatgattgagtcatacgtactcagacaggcatggtggtgcgtgcctgtaatcccagctacttgggaggctgaggcaggagaattgcttgaacctgggaggcagaggttgcagtgagccaagattgcgccactgcactctagcctggcgacagagctagactccgtctcaaacagaataaaaataaaaatgaatagtcactgtttaacctttcttgtccagtttttgtgtttttaaaacatcctgcagaaatgtgtatctttccttggggttgcgggggtatacctgtgatatgtggctttttaaaaaagcttttgctgcttttttttttcccctttttttggagagagagtctcactcggttgcccagactggagtgcactggagcaatcattgctcactgcaaccacaaacttgcctcggcctcttaaagcactgagattacacgagtgagccactgtggaaggacaagctgcttttatttatgcatattaatttctttatcacacattttatttttaaaattatttctagtgtcttgagtttaatgttcattttttatttttcatccattattttttcaaatatgaaagaactcaacactatgaattgtccatggagtataaatttggttgccttttatagatttttataggtaatattctaattatttcattttattaatattttctaatggaagttccacattttccaattttgcttgagggttgcttataaaagttttgtttttatggttgtttattttcacatctgagaatgttttgtttttagttttgtgcataatttataattgggtaaactcttctgcaacatcatctctacctcctaccttgcatgctattctatagccaatcattttcttttatatttaccaaatatctcttaaatgcaggccataagtctgacacctcactaggatgtaataatatacatgaagcatacagtgtatctggattcaatgatcttacaatgttggtctagtggcatacagtaaacaaataagagcaggcatggtaaacatattgagatcatatatatataaaagttgagtggggtcacaattgagagaccgtgagatttcagagaaactcttcatagagatgaaagatgagaagagttttgaggggagaggtatttacctagtagaaaatatttggatggaaactttctgaatagagaacaacattctgtattctaaaatctaataactttgtagagggctccttcttcttctgtatgatctcctattctgtgctctttatcctgtcttacttccatctcacacagatacaatttttcattcactttctcttcttattttaaactttttccttctcactcaactctttccttccaaatttatgaatatatccagacggcactcattctaacacacatgtacacacacattcctcctcttaactcttcatcctgttcagctcttgctcttgcccataatcagaactttctgtcatgattttctcattgttcttgcttttctcaactcatcataatgtgactcttatcccaggaatggcaggaagttatttcgctgagatcaccactgacgatctaattgcaaaatctaatgggcatctttcattactcttacttttggaggcacacgatcatattatgcacatatatattgccgacacaatcccgatattatctggattaagattgtttgcatgtatgtcccttaatagactagaaaaatgtgagggtaagagatattatgtattatctatctttgatctatctttgtagccctaatgtttagatcagtgcttagtacataatagacactaaaaaatttagtgaactcagtggtgccagcaattattcagatattgagttctcctggggagattctttgtgatgtgctgatgcatttaggtcaactctgtccaattatcattttcatgtcctagagtcattctaaacactctagctcctgagcgtatgtattactttaatgatatctttaccaatgctttggtgtgttagtctattcaggcttctattacaaactaccattgacaagctgttttacaaacaggaggaatttgtttctcacagctttagaaaaccagaaagttcaagatcaaggtgccagcagagttagtgcctggtgctggccacttcctgcttcatagacagcattttttgttgtgtatccacatgacagaaagggcaggtaaatatctctggagcttcttttttaagggcactgatcccattcatgaagactctactcttgatgtaattatctccaaaaggccccacaaccaaataccctgacattggggattaaatttcaacatacagttttttggtggaatgcaaacattcagaccatagcaactgacataaatatgttgaatcattccctcattcaaaaggggttttccatctaatggatgtagatgttatgagtagagaatcagagaccccactgctgtggaagcagaccctccaaattagggcaatttttctactggaaggttttgaaagcttcaacaggccacaatagtttcatttgagacaaactctaattccatgtaatatatgtgtaatgtgtgatgtgcaaagtgtgtttgtgtgtgtgtgtctgcgtatgcatagacacatccgtgcatgtctgtttatctcatagggatcttggttttacacccaagaaaaaagtatggcttctcttaattctgcttcttcttaccagcccttagaattcaacctgcttcctgtcacagaaaggtatatgactatcttaaaatatgattttattagccccctttttctctattatgatcttggaaacttgtcattattattcagattagctttactactgtattaatgagataattaatgtatgtaaggatgtatgtgtgagtgtcagtgtgtgggtatttgcatgcataattttgtttttttcttgaatttcactgaacagatttgtcatttacatcatttggatacataatacattccatttgtgtaagtgttttttttttttttttcatcttttgaaaattaacaatggctatctggagccaaagattttaccagatagaaataaggtttctctttattatagaattgacattttcaatttttattataaaaagcaaattgaagtctttaattgcctgggttttatgaatgtattgaattttctaatttcaatgttaatggatacatatttctttctagatttcttttcttttaaataataagcaactggtttgacatgcctttaatcaagatttatcatgaccttattagaaagttaatgtttggaacatttactctctgatgaaccaccaattttgtattttacatttatctgcaatttccaacagtgaagaggttgtctgcaaatggaattaattcttctccatttggttatcatctcctttgctccaatccctggtaatagctaagcttgttcaagatattaaagaggtagatcaaggatctaaatggtagggaaaattttcaatttcttaaatttcatttattatgttgataaatctggcctctttgatagtttgtcattttcatagaattgattattcattagcaccattgcagaccatatagctaccatctttgcttaggttttctagcctctggatctgattgagaaaggaagacatttgaaagcatatctgagtacacatgactcaatcattgattatgtcaatttatatctacacatggaaatacatatatatgtgtatatatatgtgtgtgtgtgtgtctatattgcagttaatgtaatgcttcatggagtatatactttagtatgtcaaaatggttatatttcagaactcctttcccttagaaatatattgtttgaagtacattgttattgaactacagtatctattcagaaaagtacaagactcataagtgtaaagctagaataactttcttaaagtgaatgtacatatgtaaacagaacataaacaaagtcataaaacaaaattactagtgcctagaatcacccttatatttcctaccaggcactcacttcttacaattacaacttttgacaccatgtattatgactgaacttttgtgtacttccaaacttcacatgtggaaatcctaatacccaatgtgatggtattaggaggtagggccttagttttaggtaatgaatgtggatcccccacgaatgatgctgtgcctgaatgttggtgtcctcccccaatttgtatgttggaacataatatgcaatgtggtaataggtaagggaaagtaattaagggaaagtaattaagtcatggggactctacccccataaatgggattagtgctcttataaaaaagtttaaaggagcattctggtttcttccatgccttccagcatgtgaggacacagcattcatcccttctaccatgtgaggatatagcaagggtgtgccatctatgaggaatgggccttcgccagacacaaaacttgtcagtgccttcatcttggactttgcagactccaaaactgtgtgatataaacttctgttatttatacattattcattctaagatattttgttataacagctcaaacggactaagacaaatgaaaattgcccttataagaagataaaccacggcttcttttcttggtgtttggttttcaacatgtgaggacacagtaaaaagacatccttctgcatactaggaagaaggccataaccaaaatccagcaatactggcaatcttatctcagacttcccaacctccagaaccatgagaaatacatttttgttgtttaaactatccagtctatggtatttttgctatagcaggtcactgggaggattccccttcaatggaattgaatgcaattcagcttaatcagtgttcaagatatagcgctgtttctctgattaccaggattcaggggttcagacggaaattggagtggtggtaacattcattattacctctactgacctacaggcaaaaattttgtttcctgttcctgtgactttatgctctgctagcctaaaggtcttaattccagagggagggatgtttccagaaaaagacacaacaatgattgtatcaaactggaagttaagactgacacccagcaattttgggctcctcctgcctcagtcaataggctaagaagggaattactttgttggctgggacgaatgatcccaactaccaagaagaatatggactgtgactctacaatggtggggaggaaaaatatgtatagaataatagaaatcttgtacggattctcttattatgactgtgcactgtaattaagatcagtgaaaatcgaaaacagcccaatttaggcaggactatgattggcctaggcccttctggaattaaggtttggttaccctgccaggtaaaaaatgacaaccagctaagatgcttgctgaaggcaaatggaatacagaatgagttgtagaggaaggtagtttgaaataccagccttgatgatgtgaccggtttccaaaaggaggactgtcatcatcatgagtattcccttcttattttgttatgaatacagttgtgtttatacacaaatacgtgtgtgtgtgtgtgtgtatatatatatatatgtatatatgtaaagcaaatgcctttgatttattttctctgttattctataataatttaaaataaaacatattgactttatattagtatttaaatattgtcaatgttacatcatagtatttaagttacgggatgtcaggagaggagtaaacatcactcatttactttactttctcttgtgtggagatcaatggattttttgttgtatgcagaatagctgcatcatgtcaggaggaattatgaccattttcctgtcttaatttggagattaagtatggcttgaggagatgtgtacatgtgcccagttgacaaggggtcttcttgttatggttcatttaatgtgttgacctggactgtgctaagggatgctcagataactagtgaatcattattgtgggtgtttccatgaggatgtttctgaaataaattagtatatgtattggtgaactgagtaaatgtaaatgcccctgctcaatgtaaatgggcatcatctaatctgttgagggcctgaataaaataaaaaggcagagaaagggtgaattcactctctatgcttcagctgggacattcgtcttctgctgcctgtgaacataagtgctctggttcttaggcctttgcatttggaccgggacttacacagtggttcctctggtcactgggccttcatacttggactttgtcatttaacatcaactcccctgatgctcaggcctttggacttggactgaaactataccactctctttctggtcccccagcttgcagatagcagaacataggacttctcaacctctgtgattgtgtaagccaattccttataacaaatcttatatagctagacatagatagatgatagatagatagatagatagatagatagatagatagatagatagatacatagatgatagatagtaagtagatagtagatagatcgatcttctcttgcccctttttctctggagaatcctaagacaactggttgaacatcttttcatgtgcttgtttaccatctgtagatcatttttcagtgaaatgtctgttcataccttttgaccattttccagttaggttattattaattttttacagttgacttttaagactactctacatgttctggatataaatcctttgttagatacatggtatacaaatattttctccctgtctgtaccttggttttcttcctcttaaaagaatctttagactttgatgaaatctaatttataggtgtgaccattcgtgcagtaccccagtatgttgttatgctatgactaacctgcagtaaaatccatctacccaatttataatttcatttattttgttttttcaaaatttctagttaaaacaataaattctaatattctaatgaaatcattcacttttttctcttatctgccattatttgccttccaactataatatctggaatacctcagctctgttattattttatttgttaatcttccttttggttataggattctgtcttttggtaggaggaagtttttgacgaaggcaaggtattagttataaacgaagttacacactccatgtggtaatattttcctgcacacatagtttcgaatttcctctgctaagcagagagaatgaggactgttcactttaatcttaacagagagactgatttcaataggagcttcattgcactttttgtaaagcttggtagacttctgctttgacactgatcccagggtacatactttcaactacagtgtgactgagtctagaccttacaactgagagcctggtatcataactgagttcccttcactggctggtcctcagctttccttttcatctcctgagcaaaaataaattgcagaaaactttacaccactttacagagaatatcagcttagcttttcagcaccttgctacttgtagcttcagaatttggcaaactttttgaaaataaaacaatacacattcaatgcccagttttctgctatttaatatgttgaacattttgtgccataaagctttcaattttctctctagtttgttgacactgacaaacactttgcttatacctctgtctttcagcaaccattctgcctgagcaaagactggattttgagctctcagtccatttatgacaaaatggactcctgaggtaaaagtatctactcaactctcagtgtttcttctctctcccagaatcttgagcactctggtcttgtttctgtattagttccctaatgcttttaagaaaaagttatttatattttatgtaacttttctactgtctttttctctgtgaagcattggttggctttgagatactttatttttttgtctttttgaagtacttttaaaacactgaagcacgaaaacagaggcacaatcagttttgttcatagttgcatcttgcacaaggatactcgtattacataataaatttggaagataaatttgctgttttcaaataagtaacagactgcttttgtggaataaaaaagtggaaaatttgttttttttgtgtgtattcacagagtcgtttctatattttatctaaatttgtatattctaagtagaattgaatggacaaatcatttgttttgtccattattcatataatggacaaataattaatcattgtgtcaaatcatttgaagtcagtaacaaatttcctgattaaattttgtttgctgctctacacttgaatttttaataactttccagctattaaattgctatgttataacatcattttgaatattattgataaggatcttgttacaaactgcagaaatgttactaggtaaaatgagtgtttggcctagccaccacatatgcaatttagaacaatgtgatttccattcgttcatagaggtgcgatccccacctctagccaaagatccacagccacgcagggtgcatggtggctccccttctcaccccccttccctcctggatggggtgcttgggcggatccacggcacacacctgtgtctgcacatgtggggcgaggggtatgtttgcaatggccatgcagggtgggagagaactgtggctgctgcccaggccccagggcagtctcaggggccaggggcctcacgtggctagttggccagcatgtcccacccgccatcccctcctgccatgtgcccatagagtctttcctccccgggcgagaggtccggctttgtccgagccagaggaaggatacagtgatttaaggaatccatttgcatagaggaagaggttcttctccacctaaatcgattttttttctttttccttttctatgtgagaggtttcttttcctacctctgcactctgcttatgataggaaagcaacagaggagccatcccactggctaataacggcaaatttggcaaagtctgtctgggacttaatctaaataaatccatgcatcccccgagacacctttttgtcccaaactcaattacaaactttggttgaagccctagaaaggaaaaccagatctgagggatccaaagccaggcaacaggcacagagtaaatgggcaggactaattcctgttgattaagcccctgcttcatggaaggaggccatgttccatgtcatatatagataaggcctagggaactcaagagatttcatgactatgaattacagtaaaaaataagtactcttgcaaaacacagttggattgtttgtaacacaaagaataaatgcttgagaagatggaaaccctattctacatgacgtgattatttcacattgcatgcctgtcaaagcatcccatgtaccctataaatatatacacttactatgcacccacaaaaattaaaaataaaaagtaaaaatttagaaacaaacaaacatacaaaaaccaaaacacatcatacttcagttttgaaacattaaggtcccaattatgtttactcaaaaataggtttttaatttggtagtttttttatttttgagtgtgaatataaggccaagcttgcttctattcttataatttgagaatttaacaagcattgtttatttgtggacgtcaaactcttttttatttgacatatacaatataatatatataattataatattatatattataaaatctctactaaatagatatatttagtagagatggggtttcatcatgttggccaggctggtctcgaactcctgacctcaggtgatccgcccacctcagcctcccaaattgctaggattacaggcatgagctactgcgcccagcccctcactatctttatgagcagacacaacaaagatttattgagtaaatactatgttcagggcactattccatgtactaaaggatttttaaagataaataagacatggctcttatctctgaggtgttcacattctcatgtgaataggacaggcttatatacaatagtctaacacgaggcattatgtgaaaagtatatttcttcgcctcttctcactgcttagaaaagtgtctagaacatagcgtgcactcaattaatactttctattagcattaatattaatcttgtcatcattggaaaagatataataggaactgacactggagaaataagtcaggtccaaattatagaaagattactatggtagtcaaaatcccccacttctcatctccactgacactccaaccttgatctagatgtggttatacctccataatctctcactttgccgcacagtctccccattggtgtccttgactcttaatgtgcactcctccatgttcaaaaaacagaaccattcttaaaatataagtcaagtcatatgatacttgtgctcagaatcatcaatggattccaaattagataaaagtataagcaaaaaagccctattttgtcctaaaatgccctacagatctgtgttcccactatttctctgacttcgtcttttactcctctcttctttatttttctcaagttacaatgccccattggtattccacaaaaacggcaaacatacttctatctcaagtcctttgcccttgctattccatctctctggaaaaactctttacccaaatatcagcatgaccaactccttcatttagtccaagtctctgtgcaaatacctctgtatcagagagtctttaccttatcatcctatgtaaaacagcactccaaatgaccctctttaaattttcagtatgccactcatcaccacctcaaatattgtattcactgtgtgttttactttaactcttccccaaccctagattataaactctgtgactgaaaccgtaactattgtttgctactatattatcagcagtagaacagtgcttgactcatagtgaggtcttgatgaatttggttgaatgaatcacttaatcaattgtcccaactttataaactcaagtttaaggtatctgaaaattctagtctaatcccaaaccatattgatgtattggtccttatttaaacccttaaaaaataggcattaattgctttatcatgcagtctcttttaattagtgtaattttgactagattgatatgctggtttagtaattactttgtgattttatatgtatatgttacatgcttggattataatagaaatgctagattttaaagttactgaaacctataagaaagcagttttgtcttatttttttaaatataactcagccatcttttctgtacacacacatacacacacaacctcatagatgtggttttaccaatatcaatttaaagaagggcactatgatgtttgttttagatctgtacttcctaaattatctgtagtctaagaacagtttttctctccatctaccatggattcacacttttataaaataaaataattcattaatataaacttaatagagaaaagcaaagacatgagtcaagtctatgttttaaatgattagattcaagagacataaagttttctgtaaacatttcttttttaacattctgtttcaatttatgtacttatcacaaaccagaatcaaacaattcctggattagcactggtatccagacctaaatttgagtagcattgctttatatattaaatttcgaacacctctctacaaagtatttatattccagcttttttaaaagtaaaaactgactataagagaagttaacgtaatacagtaaagactatttaacaggaacatttgatgaagtagatcattcccgtcttctaaaaactttcactttctttgtttttcattacaccttgttcttctgatttgtgtttttcccctctgatttgtttcttttctgtttccttcacttcttcttacttatccaaagattacagtatctttgaaatatgttttgaactctcgtcttttctacatcaaaatacacttcctggctccaattgtgaactataaaacattgattaaaaatgtatatctaacttctgatctctctgcacattgtcacatttgactactgtattaatcatttttttaaatgttatgtattttatgatgtgttgacatcttacaaaggctactagccatgtaaagactgccagggccagggctagccaattctttgagttagtaaagggccaggttgggagcatgtcttgcatgtgcaatcgagccaatctttggtctatagaccaaagtctatagctccattcacagccttgtctaactctttacacaccaagccaagatttaccttgccctaaatcacctagggccaaatataaaaaaaaactggagaccgtctttatacctcaaggccctttcaaattattcaaaccagccaatattaagttgtttattctgtccggccttgcttttcccatagaaacccccataaagactctggctctggattccctttgcttctatctttttccatgtgagaaaagcctagccctctgtggtcctctgtgacatttggcgaccctactctgttggacctgtaaatataatcaaacctcttccttctaggccttgttcttgttttcctttgcagctacactgactgtaccacaccacatttttcgaacttttatgcgtgcccatatgcctcacaaacatatataattcaacatacccactattgaaatgaacattgtctcttcaaacgttttccttctgttaatatttcctacatcagcaaatggaaacatactctttcaataaacacaattgggaaactttaaagtcatccttgactagcctagtttatccatttatcttttattattcaatcaattggtaacaaagttctgcctccaaaatgtatctcaaatatcatttacttctctatcatttttacaaatatcagtatagtccaggacacaatcatctccatcatgaagtcctgactggcttcccagtttctgctcttactcatcattctgatctatcttccactaactgccacgtaatctactttttaaaatagggtaagattgtatcttgttttcctgagacaattgtaattttcatctattatctcatatagtgattaatggtaccccttcctttctattaagtgagacagtatgtacaatatattctatcttcacgctacctaatagtcattaaaataatttattgagccatgacaaagtaattggctccagaatagtttcattctcttaaaaaactagaaaagcatattaaataagttcgggctgtggaaagcagatagtaaaggatagcaatcactaagaaaagtgaaaacactgaagtaagtcctatgatcacccaggatttctccctgcgggtaactgtaggctatggtgcaaggacaggaaatccctacatatcgtagtagttctattaaattgaggatactgagttaagaaagccttaccaactggaatttgtcagatagagtaatagagaagggagggtgagagtaaaaaatagattcaggtccgggtgcggtggctcacgcctataatcccagcactttgggaggccaaagtgggcagattacccgagattgggaatttgagaccagcctgaccaacatggagaaaccctgtctctactaaaaatacaaaattagccgggcgtggtggtgcatgcctgtaatcccagctactcgggaggctgaggcaggagaatcgcttgaacccgggaggcggaggttgcggtgcgccgagatcacaccactgcactccagcctgggcagcaagagtgaaactctgtctcaaaaaaaaaaaaaaatagattcaaaaatgtacatatggattcccttgggtctttcactaaatgttaagctgaacatgcacagggtgaaattccataaggctagacagagagcaactgggagacaactgtatgctgaacaattcccagaattcacataggcctaagaggcattttcagtagctagagtggaaaaaacttgtttagcacctagggcattcagtgaagacaccagaatggctatttctaaaaagtagacctaaaatgtcctcagagtaaaggatacttctgactcatgttaacaacacttaaaaacaaaccttaaaagaattgagctgatgcgcgaaatcttatatcaactatttaaagaaataaagcaaaatccagacaaccaataatgttacattatcaagaaatcaattaataattagaagatgtgttaggaagcaggaaaatataacatataaccaaggggaaaatcacacaaaagaaatgaacacagaaataacaaacatgataaacagaaaaaaaaactttaaaatggctattacaaatgtgaagaaggccttaaaggaatatataaacatactgagaaaaaatagaaatatttttgttgtttttaattgtttttagacttttcttctatcctttttttttcaacttttattttgagttcaggggtatatgtgcaggatgtgcaggtttgttacataggtaaacatgtgccattgtggttttatgcacagatcatcccatcacctaggtattcggcccagcatccattagctattttgcctgatgctctcactcccccaacaccaagcctccaacaggccccagtgtgtgttgttccctgccatgtgtctatgtgttctcatcattcagctcccacttactaatattattattttttccgaggcagggtcttcctctgtcgcccaggctggagtgcattggtgcaatctcagctcactgcaacctctgcttcccgggttcaagtaattctcctgcctcagcctcatgagtagctgagattacaggcacgtgtcaccctgcccagctaatttttgtattcttagtagagacgaggtttcaccatgttggccaggctggtcttgaactcctgacctcatgatccaccctcttcagcttcccaaagtgctaggattacaggcatgagccaccgtgcctggccctcagctcccacttataagtgagaacatgtggtgtttggttttctgttcctgcattagtttgctgaggataataccttccaactccatccatgtccctacaaaggacataatctcattccctttttatggctgcatagtattccatagtgtatatgtaccatattttctttatcctgtctactactgatggtcattttgggtttattctatgtctttcttattgtgaatagtgctacaatgaacatatgtgtgcatgtatctttataatagaatgatttatattcccttgggtatatactgagtgatgaattgctgggtcaaattgtatttctgcctctagatctttgaggaattgaaacactgtattccacagtggttgaaataatttacattcccaccaacagtgtaaaggcatttcttattctcagcaaccttggcagcatctgttttttttgtttgtttgtttgttttgacattttgataacagctattctgcctggtgtgaaatggtatctgtattagtccattttcatactactatgaagaaataaatgagactggataatctataaagaaaaaaaggtttaatggacttacagttctgaatggcttgggaggcctcacaatcagggtggaaggaaaaggaggagcaaaggcttgtcttacacggtggcaggcaatgtgagagagcaagtgcagggaaactgcctttataaaaccatcagatctcatgaaacttattcgccaacatgaggacagcatggaaaaaaacccaccccatgattcaattgcttcccaccgggttccgcccacaacacgtggagattatgggagctataattcaagatgagatttgggtggggacacagccaaaccatattagtatctcattgtggttttgatttgcatatctctaatgatcaatgatgttgagctttttttcatgtttgttggccatatgaatgtcttcttttgagaagtgtctgttcatgtcctttgcctatggttttttttttcttgtaaatttatttaagtttcccctagaccctggatactagacctttgttagatggataccttgcaaaaaatttcccccattctctaggttgtctgttcactctgataatagtttattttcctgtgcagaagctctttaatttaattagataccacttgttaatttttgcttttgttccaattgcttttggcattttcatgatgaagtctttgcccatgcctatgtcctaaatggtattgcctagattttcttctagggtttttatagttttgggttttacatttaagcctttaatccatgttgagttaatttttgtatatagtgtaaggaaggggtccaatttcaattttctgcatatggtttgccagttctcccagcaccatttattaaataggaaatcctttccccattgtttgtttttgtcagatttgttgaagatcacttggccgtaggtgtgtggtcttatttcttagttttctattctgttccactggtctatgtgtctgttcttgtaccagtaccatgctgtttggtttactgcagtttaatttgaagtgtagtgtaatttgaagtcaggtaatatgatgcctccagctttgtttgtttttcttaggattgtcatggttattcagggtcttttttggttccataggcattttgaaatagttttttctagttctgtgaagaatgtcagtggtagtttaatgggaatagcattgactctataaattacttaaggcagtatggccatttttacgatattgattatttctatctatgggcatgaaatatttttccatttgtttgttttctctctgatttctttgagcagtggtttgtagttctctttgaagatgtccgttactttccttattttatcctcttcatagcaattgtgaatgagagttcattcatgatttggctctttgcttgcctgttgttggtgtatgggaatactagcaagttttgcacattgattttgtatctagagacattgctaaagttgcttgccagcttaaggagcttttgggctgagatgataaggttttctagatgtaggataatgctatctgcaaagataatttcgcttcctttctttttatttgaatactctttatttctttctcttgcctcattgccctggtcagaacttccaataccatgttgaataagaatggtaagagagggtgtgcttgttttgtgccactttgcaagggaaatgcctctagcttttgctcatttagtgtgatattggctgtgagtttgatatatgtgaatcttactattttgaggtatgttccttcaatacctagtttattgagagtttttaacatgaagggatgttgaattttatcaaaagccttttctgcattgattgaaataatcatgtgttttttgtcttttgttctgtttatgtgatgaatcacattcattgctttgcatatgttgaaccaacagtttataccctctcagatatgaagccaactggatcacgatggataagctttttgatgtgctcctggatttggtttgccagccttttattgaaaaatttttatatcaaggttcatcaaatatattggcttgaagtttttgttgttgttgttgttgttttgtatctctgccaggttttggtatcaggatgatgctggcctcataaatgagttagaggggagtccctcaattgtttgcaatagtctcagtagaaacggtaccagctcttctttttacctctggtagaattcatcctttagtccttctggtgctgggctgtttttgccttggtaggctatttattagtggctttattttagaacaatttctcagtctattcagtgactcaatttcttcctggctccttggtagattgtatgtgtgcaggaatttatccatttcttttagattttctagtttattttcatagaggtgtttgcagtattctctaatagctgtgagtagttcattggggtcagtgatatcccctttatcatttctgattgtgtatatttgattctgttttcttttcttctgtattaatctagctagcagtctattttattttattttatttctcttaaaaaaacagcttctggatttgtggggttttttttttttttgaagaattttttatgtccccatctccttcagttcagctctgatcttggttatttgttgtcatctgctagttttggggtttgtttgctcttgattctctagtttttgttaaaaaaatttgtgatgttaggttgttaacttgagttctttttaactttttgctgtgggcatttagcaccatgaatttccctctgaacactgctttagctccatcccagaaattctagtacattgtctctttatcctcattagtttcaaataacctgttgatttttatcttaattttattatttacccaagagtcattaaggagcggatcgctcaatttccatgtagttgtgtggttttgagttcatttcttaattttaagttcaaatttgattgcactgtggtccaagtcttttgcatttactgaggagtgttttacatctgattatgtcatcaattttagagtaagtgctgtggggcaatgagaagtatgtatattatattttgttgtttttgggtagagacttctttaggtatctaccaggtctgcttgatccagagttgagtcctgaatatcttcgttaattctctgtctcaatgaactgtctaatattgttggtggggtgttaaagtctctcactattattctgtgggagtctaagtctctttgtaggtatctaagaacttgttttataaatctgggtgctcctatattaggtgcatatataattaggttagttagcttttcttgtattgaacattttacctttatataatacccttcattgtcttttttttatctttcttgatttaacatctgttttgtcagaaactagaattgcaacccctgcttttttctgctgtccattttcttggtagatttttctccatctctttattttgatcctatctgtgtcactgcatgtgagatgggtctcttgaggacagcataccaatgggtcttgactctttatctagcttgccattctgtgtcttttaattggggcatttagcccatttacctttaaggttagcattgttatgtgtgaatttgattttgtcatcacgatactagctggttattttgcagacttgtttatgtagttgcttcattgtgccattggtctttgtacttcagtgtgtttttgtagtgtttggtaatggtttcctttttcatatttagtgcttcctttagaagctcttgcaaggcaggccttgtggtaatgaatttccacagcatttgcttgtctgaaaaggagcttatttctccttcacttatggagcttagttttgccaggtacaaaattctgggttgaaaattcttttctttaagaatattgacagccaggcgcagtggctcacacctgtaatcccagcactttgggaggccgaggagggcagatcacgaagtcaggagatcaagaccatcctggctaacacggtgaaaccctgtctctactaaaaacatgcaaaaaattatctgggcgtggtggcgggcacctgtagtcccagctactcgggagtctgaggcaggagaatggcacgaacccaggaggcagagcttgcagtgaactgaggtcatgccactgcacttcagcctgggcaacagagtgagactccgtctcaaaaaaaaaaaaaaaaaaaaaaaaaaaaaaagaatattgactattggctcctaatctcatttggcttttagagtttctgctgagaggtccactgttagtctgataggcttcccctttgtaggtgacctggactttctctccaactgcccttagcattttttctttcatttcaaccttggagaatctgttgattgtgtcttgtggttgatcttctcatggagtatcttactggggttctctgcatttcctgaatttgaatattggcctgtcttgctaggttggggaagttctcctggattatatcctgaagtgtgttttccaacttggttctattctccctatctctttcaggtaactcagtcagtcatagatttggtctctttacataaccccatatttcatgcgacttttttcattgctttttattcttttttctctattcttgtctgcctctgttatttcagcaagatcatcttccagctttgagattctttcctttgcttggcctattctgctcctgatacttgtgattgcattgtgaaggatctcgtattgtgtttctcagctccatcaggttggttatgttcctctctaaatagactattgttgctatcagctcctgtattgttttattatgatttttagcttctttgcattgggttacaaataattgtgtattttatgtgtcacaaagtaatattttgatacacatacacattataatgatgaaataagtgtaattagtatatccatcacctgaaatacttatctgtgacaggaacatttaaaattctctcttttaggtattttgagatatacaatacattattattaactatagtcaccttgctgtgcagttgaacatcagaacttttatctcttatctaaatataactatacccatcgaccagcatctctaatttctccatccaaacgcttacccccacagcctctggtaaccaccattctactctctacttctatgaatttgacttttttagatttcatatataagagatattatacagtatttgtctctttgtggccggcttatttcacttaacataggttcattcatgttgcaaattagagaattttctatttgttttcatcttaatgactgaatcgtattcattttacaattatatgtagtactttaccttttaaaatgcccatagttggacatttaggttattttcatatcttggttattgagaatagtgctacaataaacatgggtgtgcagaaatacctttgccataccgattttatttcctttgggtatatacatagtagtggaattttataattatatcatcattctattttcgttctttttaaatttttaatatttaatccttgtgggtacatagtaggtacatatatttatagggtacataagatactttgatataggcatgcaatgtgtaacaatcacatcctggtaaatggagtatgcatcacctcaagcatttatcctttgtgttaaaaacactccagttatactcttttgattttaaaatgtataattaaattattattaaccacagtcatgccgttttcctgtcaaatactaggtctttattcattctttctatttttttttcttttttttttttaactcattaaccatcctcacatccccccacccctgacacacactgagtacccttcccagcctctggtaaatgtcctcctactctctatctccattagttcaactgttttagtttctagctgccacatataagtgagaacatgtgaagtttgtgttttcattcctggcttattttacttatcataacctccagttccatccatgttgtagcaaatgacaggatctcattctttttatggctgaatagtactccattgtgtatatgtaccacattttctttatccattcatttgttgatgaaaattaagattgcttcccaatcttggatattgtgaacagtgctgcaacaaacatgggagtgcagatatctctttgatataatgatttactttcttttgcatgcatacccagcatttgaattactggactatacaatagctctaattttagatttttaagaaacttacatactgttttccaaaatggctatgctaatgtacaataccaccaagagtgtataagggctctcttctgtatatccttgccaatgtttgttatttttcactttttgaaaatagccagtctaacagatgggaggtaaaactcattatggttgtaatttgcatttctctgatgattaaagacattgaactttttttcatatatctgttggacattcatatgtcttcttttgagaaaagtctattcaagttctttaccaatttataagagttgtatttgttttattgttactaagtagtttgagttaattgtacattttggatattagccacttactggatatataatttgcatatatttttcccatcccatgtgtaatctcttcactctattaattgtttcatttgctgtgcaaatgatttttaggttgattcagtgtcttttgtctatttttgtttttgttgctcaaacttttataatcatatctaagtattctgcccagtgcaatattgtgttaggccattattgcattgctctaaagaaatatctgagacctggaaattcataaagaaaaaaggtttaattgactgacagttgtgtagcttttataggaagaatggtactggcatctgcttggctcctggtgaagcctcaggaagcttttagtcatggtggaaggcaacgttggagtagtcatctcatatggtgaaaatgtgaacaagagagagagtgggggaggtgccatacataaacaatcagatcactacagcaaagacagtaccaagccatgtgagatctgcttcgatgacataaacatctcccaccaggccccacctctaacactgggattatgtccttctgaaatttcaaaatataatcatgccttttcaataggacccaaattgtcaacacatttttgaattaactcaaaagtccaaagtctaaagtttcatttgagacaaggcaggttccttccacttatgagtctgtgaaatcaaaagcaagttatgtacttccaagttacgatggggtacaatggggtatagctattgaataaacatttccattggaaattgaagaaatcagccaaagggaaggccctgtgcaagttcaaaatcaaacagggccgtaattaaatcttaaagtttcaaaataatctccgttgaatacatgtcatgcatctggggcacactagtgcaaggggtgggcacactagtgcaaggggtgggcacactagtgcaaggggtgggctcacaaggccctaggcatttccacttatgtggctttccaggtttcagtccccatgcctgctctcacaggttgttgagtggctgcaacttttccaggtacaaggtgtaagctgcaggtggatctaccactctgggggcctggaggatggtggctcctttcccacagctctactaagcagtacctcagtgggtacactgtgtggtgccttcaaccccacaatttacctccacactgctctgtcagatgttctctgtgagggctctactcctgcagcgcactttttcctggggacccaggctttctcaaacatcctctgaaatctaggcagttgctgccaagttttctttactcttttactctgtgcacctgcaagattaacatcacatggaaactgtcaatgcttatggcttaaaatgtctgaagcagtggctcgaccttatcagcctggactttaccgtccatatcactatcaatattttggtcacaaacatttaaccagtctctaagaagtttcacgttttccttcaacttcctgtcttcttctgagtcctccaaagtcttccaacctttgcccattatccagttccaaggtcgcgtccacattttcaggtatctttatgaaaataacccattcctggcaccaactttctgtgttaagctgttcttgtattgctataaggaaatacctgacactgggcagtttatacaaaactaggttttattgcctcatgtttctgcatgctatacaagaagcctggtaccagcatatgctcaacttctcatgaggcctcaggaagctttcattcatggcagaaggcaaagggagagcaggcatttcacgtggcaagaacaaaagcaagaaagatagttgggggagaaagaagagatgtcatgcatttaaacaaccagatgaccattacaaagacagcaccaagccatgagggatctatctccatgacataaaccactcccactaggccctaccttcaacactgaggattacatcacaacatgagatttggagaggacatcgaaactatgttaaatgtcacacagtttttttttttctgttttactctagtaattttattattttaaatcttatctttaagttgttgttctatttttagttgattcttatataagggtgaaatcagggttcttttttttcttctgtgtatgaatatccggttttcccaacagcatttattgtagagattatcctttctccaatgtggattcttagcacctttgttgaaaatcaactcacactagttacgcagggttatttttggactctcttctactacattaatcaacgtgtctatttttaggccagtatcattctgttttgattcctatagctttgtaatatattttgaaatcccattgtatgattccattagctttgtcctttttggtcaagattgctttgagtattaggtgttctgtagtttcatatgaattttaggattttttctagttctgtgaaaattcccattggaattttgatacggattccattgaatttatagatcaatttgggtaatataaacattttaacaatattaattctactaattcatgaacatgggatatctttttcatttacttgcaccttcttccatttctttcatcaatgttttatagttttcagcttacagtttttcactttcttggtaacatttaattataaatatttttattgtattataaataacactgttttttaaatttttttctggtgagttaattgttagtgtgtagcaacactactgatttttgtaagttggtattttattttgtagcttaactgaacttttaaatatgttgtaacaggttcttagtggagtctttaggattttctatatgtacatacattgacaaatccgaaagactctaattctgtaatggtggtggataaattaattatgtgtctattataaagtgtaaaaacaaaactattaaaaacaaagcaacaataatttgttaagaggcacatattataaaaagatgtaaagtataacaccaaaacagtaaaaaatggaaagagagtaaaattacagaatttttctctgcaatcaaaattcaattattctaaacttgaaatagcttgttacaagtataaaatgtttcttgtaaacctcagggtaaccacaaaacaatattttataacaaaacacaaaagaataaaaaagatatccaaacaatgcagtacagaaggccatcaaacatcaaagcaaaaaagctagacagaaataaaaaaaaaggccctaataaaacaccagaaaacagttaacaaagtggcagtagtaaatccttacctataaacaattacaaaaaaaaagtatatgaattaagtgtttcagttaaagggcttagtgtagctgaaggaatgaaaaaaacaaagcccagttatatgctgcctacaatagactcatctcaacctaaaggccactcatattaaaagtgaattgatggagaaacacgttaaagggagacagaaactgaaagagatcagggtagctatatttcatttataaaaaataaactttaggtcaaaaactgtaaaaagggacaaaacagttaatgacaaagtggtaagttcataaggaggaactaacaattatatttgctccaaaattggagtacttaaatacaaaacaataataataaatcgaaaggagacatggaatgtgacacaatagtaatagggtatttcaacactccactttcagcaacagacagatcattcagacagaaaatcaataagaaaacatcagacttaaactacacgtaagaacaaatggacctaacggatatatacagaacattccacccaatagcaacaggatatacgtttttctcaagtgcacaaggaacgttctccaggatggattatattttaggcaacaacacgattcttaacacattgaaataaaaagaaatcatatcaagtatcattttccatcgtaatggtgtgaaactggaaatcaataacaggaagagtcatggaaaattcacaaataagtgaaacataactaatacactcctcaacaactatttagtcaaagaataaactaaacaggaaatttaaataatatcttgagaaaacaagaatgaaaacagaacataccaaggcttatgggatgcagcaaaagtagttctaagaagggagtgtataacaattaaaatctacatcaaaaaagaagacagctctcagataaagagcttaacattacatcttaagcaattagtaaaagaagaacagactagtcccaaagatagcagaagaaagaaaataacaaaggtcagagcaaaaataagtgcaataaatacatgaaaaaaatagaaataaagagaataagagttggctttttgaaaaggtgaataaaattgacaaaaccttagctaaactaactaagaataaaagagagaagacaaataaataacatcataaatgaagaatgagacattacaattgataatacagaaatacaaaggatcataagagactattgtgaaaaattatatgccaacaagttaaaacacctggaagaaatgaatcaattcctagaggcatataacttactaagacttaatcatgataagatgggaaatcttaacagaccaataacaagtaaagagattaaataaaaattaaaaagtctgttcaaggaaaagcccagatccagatagcttcatggatgaattctaattaacatttaaagaactaatgccaatcattctgaaactcttccaaaaaattgaagagaaaaagagtacttccaaactaactttacaaggccagcctcaccatgataccaaagctagtacagtacactacaagaaaagaaaaactgcaggctaatataactgataaacatagatgcaaaaatcttcaacaatatgcatatggactccaacttagggtggttcaatttaagattttttaactttatcatggggttatgaggataatatcttcaacaatacattaaaagtgtcatcatttaccatgatcaagtgggatttatccctgggatgcaagattggttgaacatacataaatcaataaatgtgatatgtcacatcaacagaatgaagaacaaaatcaacaccatcatctcaatagatacaaatgaagcatttgacaaaacttaacatcattttatgataaagtctattaacaaattaggtaaagaaggactattcctcaacataataaagactatatatgacaagcccacagctaacatcgtactcaggaattaaaattgaaggcttttcctttaaaatcagaaaaaaataagtatgcccattctcactacttctgttaaatatagtactggaagtcctagccagagcaattaggcaagagagagaaataaaggacatccaaataaaagaggatgaagtaaaattatctctgtttctttgcaaccacactgttttaattgccagcaatgacatgattttaaatgtcagtaaaaggcaaatatgaatttttcttcaagtacaacaaaatcaaggaaactatgtagttactcatcatgtttttcaaaggcttaatagaaattcatgagacaaaattaataaaataaaaatataactcaaggcctcaaaaatttataatgattaagcaatagaattatctacagtcaatctaatgtatttacctctacttatctccccatggtccaaagaaccatcgtctcagacctaaattatttcaaaaaaacttctaaatgctacccctgcttcttcccttgctactcatcacagatgattttttacaccacaggacaaacagtcttgctaaaacgtaggtcacagaatcgttctttgttaaaaattttcagtgtttttctatttcacttttaaagaaacaaatacattatagataaattctaactaatatttaaagaaccaccacaccaaaaatctcacagtttttaacatctctgaattcattaattatttatttgaccatgctggcctctcttgaaaaaataaaataaaataatattctaggcacgtttctacctcatagcccttgcacttgctcctcctgctgcctggaacagtcttctcccagatatcctcatgactttcctccttaccagattctcgtctttacttaaatgcccccttttcattgcagtcttccttgtccatgctacaaaataatcctgcccctttatcttccttttctactttactatttgatagcttttattccatcaactacactacctattgcatttattaactttctgtctacactaatactacaatgtaatctgcacgagtatgttctgtgcacttacgttaagtgaccaaatggcttaaatttagtagacacttaaatttcagttgaatgaataaatttctttggtcctctctagtgttgatattctgacagctaatcatattatacataattgttttgttgatggaaccaccctgttacacgtgattttaagtctattcacaagtccagtcctggcaaatgtttaacaacaagatttctgatgaaaaatgcccttatttgtagaattttattaattccatggtgaacattctctcaccacaaacacgggattgagataaaatgcacacaactgctttttatgagctgatgttggcacaaattatagcacaaattgcattaactcatttaatgtgctcaatcaccatgggagacaggagttattactttggccatttttcaaatgagaaactacaacacagagaggttaagcatgtacccaaggtcacatagttagaaaggaatctacctgggatatgcctgatgattgacccgagagcttgtgcttagaaaaattcagctatacttcaggcctttgataaattactttaaataaaattcaggttttaaaatgaaaaaaaaaaattatagccatgcatattctttaagtgtcagtcaaggacctataaatattttttaaattttttgaatatttaaaaaaatgttagttttccaagcaaaaggccaagactgtgtgctttgcttaggccattttattttcagacactgaaaatatctgtaaaaatgataatacctcactctggtttgccagagccaattagatttgtcagtatcagtctatatcttattgatcgaaaccgcaggtagtaaaaaacattcgtgtgttttctaagtgttctttcttgttttggattccttgcttaaatcagaatcttactgaactagaaataagaaagtttagactccctccttgtttttaggaatataatgtacctagctgagtggatttctatttttcaaaggcacaataatccagttaaaatgcagtgattctcttaggtactacatagattttacattgtataatcattgcaatcagccaccaaatccataactctcattagaaagcagtgtttcttttaataccattaatttagcctgttttgaagtccttattaagaattcacctagctaaaccatgacacttatatggattcgacaaacttgctctattgcctctagttctgaaaatagattttaattatcatataagattaattaaaagaaaaatgtaattcagtattacctttattttttacatcatgaagcactgagtaacaacatctatatactacgcatattgtgtataaaatcaatgaatgtataatagctgtatggaaaacaggtttaaatctaaaccaatgaaccacagcactaaaaaattaagcaaatgtttattacatcattttggatattgacctttggatatagaaagaaaacattttgaagaagaatctgagtctccacattttatttttagaggagtaggtacttctggacaccatctggtcagcccatggcattcaaaataaaacagtgtttggaatattgaaattaattattaaaatgacaaggagaattttaaatttctaacttgcagacatgggataattttgactatttctggtataaaatgacaggaggcatatctttctggcagagttttgatcttgtgaaacagctgcaacagaaacacatgaatgtttttctaaaaactagatttcaatctccacttcaacttactggatcaacatacataggtaaggctcttcaaacctagaatgcaaggatttaacgatgctgctattaaaaataaagtaactaatttctttcacataaatcattatttgttaattttcaaatggattatacacccacattttatttctttttggaatcaaaaatggatttagggccaagattttagtagaaaagaggtttctttgtagaaaaaaatattgcagaaaaaatactagtaaaaacattggacacaaaaatattagtaaaaacattggatgtgatagaaacagaagtgttaaaagaaatgaagaacaaatcggggcatggaaaatgtatttcttcttaaaaatatttgtaaaagcatgagatgcagctatctttacaattaaattaaatgtgtataaatggagaagactgaactataatccaaatactcagtaattctagtgaaatttgacatatgatagatcaatatttgtgaaaagaatagtttaatcaaaatactaggtcaagtctcttcgcaatttttctttatatagttgaaattaagagggacagcctggagaatattctaagtgtggcggggcctataatcacaataaaatattgatctgctttctcagatgatggcattttggatacacaccactctaagaaattaatcgtacaaaagcaataaatgttcatttgtgagatagtatgtaaaattctgatagaatttggtcacttattgttcatttttaaagtcaaggaataaagaaacagtctatgaagagtttcagataaaaaaccaaatgataggctaaacgtaaagctgagcattagtgttacttgacattctcaggcaacctgcaatgtgttatgaggcccttacttaattttcagttgagataagaaagttaaataaattatcattcatagaagtcattaaaacaaactacacccatgcattttccagccagaattcactgtaaaattttcattatgtgaaaaaaacctgatgaataagaataatgactttttccataagttggcacacttcccaggctagaacacaggagaacctatctaccaaaaactatgtccttctactcccttcaatgaataaactactgttttttttaaaaaaagtttatttctctcacacattaacaaagattagaagtaaacagttcaagatttgcatggcaactctgtgattatcagattatccttctactgtcaaaatgtcatttccaccttctggaccaagatggctgcctgaggtctagtcatcagagctgcagtatgatgaacaggaaaaaataaaggatgaaaaagggagcatcctcgtcctttaatgactctttcacaacgttgcaaacatcaaagagtgaactgatcttaatccttcaaaataaacaagagtcaggaggatttcaatttgaatcccaagtgtattttgggaatattttataagactaaaacaaagtgttttatgttccatgcctcagtttctctagctacaatgaaaatataaaattctgtattattcatcttccttactcaggggctagaggtgataacaagaagagattgatatgcagttcaaatatagacatgtgatagtgatacttcataacataaaaacaatattttatgactaatgggcagaataaatccttcgtctttctggcacaatatgcataacttaaaagaatgtcagagaaaaaaaaacaacattagaatggaagttgttaagaactatttaaatgactttataaccgtgtataaacttacctagaatagggatgcattgaattgttttaaataaaaaattttcttaggtcagaagggaaatcatttttgtgactgtgtgaaaaatacattctcacattggataccattccacaattaatctactgccctttttccttatgcccattatattacgtatgtattcttggcattcaaagactgcacatggtattactctgttttgcctatacttttaacaatatatttcaggacctttttactgtgattcttcaggatatttcaaaaagtattatgaaagatggtagacctagctgctggataactgtatttactgacaataaaaattggtccacttaaattttaaggagataagacaatctcaagtgaaatgaaaatcaataactggtccgtttttatctgacatactagctaagccacatattagagattaaagttagaaattaaaatgaacacaatatggtaatttcttttttggtgttagatgttctttcctccatagaagagatgtgttctagacatttttttgtgtgaaatgaatttatgttaagtgaatcttcctttctgatagaaaattaaaaatttattctgttgattataaaacaagttcttacggacttgacctttgacaaatctcctattggtgcttggtaccagcatgagctaactttatggcccaaagcaacaggacagtgtgctgaggtctgggagcaccctctccagagaatccctaatgtccaaaaattggtcaaaatctaaaatttattttgctgtacaattcacctttttttctggagttgtatttgccttcaacgagtaaggcaagatttcctgcttctgtgatgatggaaggccaataactcctttatgaagtttgattttgctcctgcagggaagatgagtttgagttttttcctgtttctaggatgatagagagcagtcttcagcctgagacccatccctaggtaaatagctgagttagggttttgtcttggctaaggtgtaacaaccagctggtcttaatttctctctaccattagaacattctgcgatcatattgttggggtattttgttgttgttgttgtgtgttctggtctttcttccatcagatttgaccaactctacctgacatggtcaaattcaagtgagaattccaaattataggtaataaagctgctctaatctggtcaaacttcttcgcagcttcaaaagaagaaaaacaaacaaacaaacaaacaaacaagaaacaaacaaaagtgctcggtttctgtgtttgcttcctgtctttaaaataaaatgttattttgtgtacttttcttccaccctatatctccttctccctttgccatctgcagtaccaaaaaaatctgaagaaggcttctagtgacttgaatccctttaaagaattcaaaacaaaggcaccacccactccttttggggtgttctgttttctttgtggagtttcaagagtcataggcagattcttcttaggtctattgctctgttttcttatgtgaaaggaaaatatcttgggcccccaatgttactaagctaaagaaaaaaataaaattcaagcttggaatttcttagggcaaacctgccttacgttctattcaaagtcatttctctgttcactgagataaatgcaaatctgataacttcctttaaaaaggttaatcagaaactcaaaagactgcaactgtttgtctcccacctacctgtgacctggaagccccctccccactttgacttgtcctgcttttgcttccagttgtcctgcctttccgaaccaaacaaatgtttattttacatacgttgattgatatctcatgtctccctaaaatatataaaagcaaggtatgctctgaccaccttggacacatgtcgtcaggacctcctgaggcaatgtcacaggtggaccttctcaaccttggcaaaataaactttctaaattaactgagatctttttttatcccatatatgagcaagtattgtacctagagtggacaagtccctcctcttactttcaggaacaccctactctgtctatagagtagctgttctttcaccactttactttcttaataaacttgcttttgctttgcactgtggactcggcctgaattcttttttgtgcaagattcaagtaccctctcttgggtctggatcaggacccctttctggtaacactgttaaaacacagaaaagtattgatgttgcaccgttcacattacctgaacgtattggtctgttttaaggcatttcttgagattatgcatgaatttttacaattggcttggaagggaggcaattgaagtatgaaagtgaagtgtaagaaaatatatcctggactggtagtgccctggcaactgtctgcttgtgttgagtcctcttctcccaatgtaaagacttgttatttgacattcagaggtatcatcattaggacacattagcaaaatagtgtttttgatattgacaaaagattatcatgatgctaagactagcaaaatattgagaattagctagcttcaacaagcctgaagtgaagttatatatgcatatattagttagcgttgctttcaggaaaatgagtatcaagttagatattagccagttatgaatgtctcattttaactaatgcaagtgatgttactgagttttcaactgaacacatgcagttgatgtatttattaatatttgaaggtagaatttgagactatttgatttcctgaagtttgaaatacgttttcataaatccttattgacaaacatgtatatgtctaaaatatgttttaattagcttaatatttattaatgtaacttttgactatactataaaaagtcaaagggcactaaagcgcttatggagaatagcagtcccatgtgccactcctccagagcaagcacttttaagttttatctcttaattcatgtgtttgcttccacatttttggataatagctttgattgctatgtttgtattttttctttccatataatatgtattgacttccttttttggtagatgagaatttagttatctcactctactttatctctctttcaacattatcaatagaattacatttcaatttttcttaaattaatattcagtggttcatttgtcaggagtatgtaaatactgcccacaattgggccacatagggtgctgtagttacatttgcttttttgtacaactctttgtcatatcccagtgttaactttccatctttttattggcctaattcaatttaatttaaacattattaaatatgttagatctgtaaaagaccttttaatattattttttcaggcattcaaacaaatgaactcattgattcatttcttttctttctttttctctcaagggtttcttttgacattctctggtcttcttgatctcagctggatctggagctctctaagatgaaattgtagctgacaatgactttcctcataaatctataatagcttaatataagctattatgtaagcctaataaagcttataaggggctttctatattaagcagctattctttgtattgcttacccttctcttttcctaatttactacccgattttatgaagcccatatgtggttggcaaaattatttgaaggcctcaaagattcctgactccttattccagttacttatcttgtcccagttattcaatcaaattcaaatctaggtactgctgtgtaaggatatggcagatatatttaagtgtttaaatcagttgatcttaagatagggagattatctgggtgtgtcagggctaattacaagagccctttaaaatcagagccttttctccagctggtcatagaaaagaaagtgagagttatgaagcacaggaagacctcaagtcagtgttactggtttgaagatggagaaggtcgcatgctaaggtatatgggaatgtgggcagcctctaggacatgaaaacagggacattacatctactaccatgaaaatttgatttttgccaacaacctcaataaactggaaagcagattccccctcagagctttcagataagaccagtctttctggcgatattgatttcagtttcataggaccttaatcagagaattcagctaactccagccaaccccagctcagacttctcacctacagaaatttgagataataaatgaatgttcttttaagctgctaaatttgtggtagtttattatgcaacaatatgaaactaacatgacatcattcatcagtttcttgagataatttataatttcttaaatgcttaaacctatatttgatactgtgtttaatatcttagtttttacttgtcaacatattccatatttgaatatcaagatacatctaatggtcacatactaaaatagatttcttaggtgtgtttgaggtgagtacctttttaatcacctaagatatggtgatggagtctgtatagtgttgattcaattaaagtttacatgccatcaaatgtacccaaacttaaacctaggaaaagtggtagcagcatcttgaagatactgtgttatcttttttgtataagtttatctatcatttataaatacctattgtgttctaaacatcatgatataacctgcgaggaaacagcaattagcaagattaagtgtggactctagtgaccagaatatgctttgctttgatgttttaataattatgcaagcttttttcaagaataaggaatgcgtcgtatactcatacctcctttcaaaaagttgagcagtgaaaaaaattaatcaaagaatgtattgttttgactctataatggtaaacaatcaatttatttttttcttactaaatgactttgttggtgaaacgtagcagttgtcatattacgacttctcttgcttcagaaattaatgaaaaacacactagtctcctgaacaagtcatctcagataactttaacaaatctattgaaaataacatcttggtttttattgatattcgaaatagcactggataaataaatgcataaaccttctcagtttcccgttactctaaatggaaaagttgtaaaaccattcctttatattcgccacaatggcagatctgttccatgaatggtaatgcatgttttaaggtattaacaaaattgattatgtaaccctagatatataatggaacagaaggctaatgcttatgccgattctgccttaagtaaaatccatctgtttactactaaggtagcatgcaactcagctttgtttgaatagaacaagatgaatacttgaggctattttctatctgctaagacaaaagtgtagggaaacacatagtaaaacttatattttttaaagacacggttcccagcaaactctaagtatttactgtctctcgaatatgatcaacccagaaaagccacatgataggatacttgcaaatcttcccataaaccccagtcaacaatcatgtgcatacaagtcctggagacactcacagagaagcaactgattattgaattttatgtggaaggaattgagatgaacagttaaagggaaatttatattagattttttcttataggtctgcagatgttttctttttggaccattataaaagcatgaagcatagctttgaaaatgttattttaaaaaatatgtttctgacataatcatttatttctgaagaaaatgctttgttcatattatagttgatattttcaatgagatgttttgattagccttatcaactcttcagtatttgccaaataccctccacccacagtcatgtttcttttgtgtatatagttctattaaagtctggtaatttttgagatcaagatcaaacaatatttcatttgtgaaaccttctataactgctgtgctttcctctgcacttgactatgtttgcttaaacttctaatagagtgattatttcctttttccttgctatgtttttaatgatgtatatttccctcaagtcggtcaaattgcaagctccttgaaaacaatgatatgcatcagaaccagaaccttcatacaagactcacatagtggtgacttcataaatgccctgttgaattgaatcttaaaaagtaatccatgtcatccatcagcaaggaaagaacaattagtatatcttgattgcggatcatttgtttccttaaaattacccagggagaaaaaattggatgaggccaagagtattcctcatagtctgctaaatatagccacaacctagggtttcataggaatagcaagaaaagctcttggacacttgaaagagaaagagaagatacagcaatgcaggactgaggctgataataatcagcaaatttacaaaagacagaaatatttaaaacccgtagattttatctctttgaattactgttttatatttatgtcttatgtattacctaccagaatgttgttcatattcacattatataaatgtgaaaatactttgtgaaattctaaggttacattgaaatgacttctatcattattatattacctaaccaaatattggctttgtaagcatctctttctgacatctcaacaatcaatccccaaacaaccaatttcttttctagtatcctgctctttaaaagcaccaaagtataggtctatactgtttcacaggcagaaggtcccaaagaagttattaaacatcccctcacaggaaagaccctgaagaaatatccctttgaagtcatggcaaacataataattggcttggtaattaaggttttgtattcatgtaacaaagttttcagtaaagcatttattagcatttatcagtacttaaagaggagtactctcagtttcaagaagacctcactattgtcataagatagaattgaaccaatatataatttgcaccgcagtatgtaacaagtctcttttagaaacaagacaacctgcatctcttattttttatatttccgttaaaataatagatgagtcgaaagccacttaagaatttacaagagttatatttacaaacaaattcatacagataacactgttgttttgtgcatttacaaaacacaacacatttatttagtcttccgcatgaaaagccagttaaagtagcttgttaccaaaaatgtgtttcaggagttgcctggctcccttataacttacaaaacttaaccatttgttacctaaactaaaaaagtagatcaataattgttttatttggaggaaagagtagcttccacgttaagaaacgatatctaagagaatatgatcttcacatcagtgctaagctctgtttctgcatctgtgagttaaagtctgttaaaattgcttcattataaatgacattcaatgactgaaggtctacacaagaggagaaaacggagttctaaaaagccactggtacatgctgaagagttcagacaactaagcaatcattttgccaaacaactgttttacctatgccaaatttctatcaggttctcgaggcacaatgaatgcctttttatttttaaaacaatttttattttatttttttaggttccgaggtacatgtgcagaatgtgcaggtttgttacataggtaaacatgtttcatggtcatttgctgcacctatcaacccatcacataggtattaagcccagtatacattagctgttttccctaaaactctctcccccaacagtctcccccaactggcccccgtgtgtggtgtgcccctccctgtgcccatgtgttctcattgctcagctctcacttataagtgagaacatgcagtgtttgcttttctgttcctgtgttagtttgctgagaataatggttttcttgaatttaatacaaaataacttatctcaagagaaaatacggataacctcttttgcccaacactgagaattatgcaacaaagacaaggttgcattctagatgttgcaggaaagtttcaactttgtgatttatgtaattttcagataatacatttcaatttgtgttcagtatatagaactgatgtacctcaacatttctcctatgtttttcttttaactgataagaatgcagaatactcaattcagagcccaattattgtatgtaattatctgctatgattaacaatatcaaagtcattgttttcattttattgattttgttgtaattttatttttgattattctcttttgcattatgtgtaaatttaaaagccacaaatcattttttgaaagaatataggacatcgtaataacttccagaattccttggaaatttcctgaactcttttgtttcttagcctatttaataaaggctgtgtactttcatagaattcacattttgtattttaattttaatcctagaatttggtttctcagacttcaattaatgattcctggagggcagtaagaaaggcagcctgcaatttcacaaaatcattgttctatttgatgatttgttataatcaaataagcatttttttaaaatttatttatgtctttgagatgggggaaaacttataagtagataggcagtgatggaacttaaacattactgtatacatttgaacaaatatatttaattgctagttaatattgttaggttctgtgttcctacccaaacctcacattgaattttaatccccataatccccacatgtcgtgggagggaactggtgggaggtaattgaataatgggggcagtttctcccatgctgttcttgcgacagtgagttctcaccaaatcttatggctttataagtgtgtggcatttgccctgctggcactcactttttgtcctgcagcactgcaaagaggtgacttccgccatgattggaagtttcccaaggcctccccagtcatgcaaaactgtgagtcaattaaacctttttttctgtataaattacccagtctcgggtatttctttatagtagcctgagaatggactaatacagtaaattggtaccgaggtagtggggtgctgtggtaaggatacctgaaaaatgtgaaagccactttggaactgagtaacaggcagagtttgaaatagtttggagggctcagaggaagacagaaaaatgtgggaaagtttggaacttcctagagacttggaggcctcagaaaataggaaggtgtgggaaaggttagaacttcctagagacttgttggctttgaccaaaacgctgatagtgatatggacaatgaagtccaggctgaggtgatctcagatggagatgggaaacttgttgggaactggaataaaggtgattcttgcaatgctttagcaaagaggctggtggcgttttgcctctgccttagagatctgtggaactttgaacttgagagagatgatttagggtatctgggggatgaaatttctaagtggcaaagcattgaagaggaagcagagcacaaatgtttggaaaatgtgcagcccgatgatgggataaaaaagaaaaacccattttctggggagaaattcaagcctgctgcagaaatttgcataagtaatgaggaaccaaatgttaatcaccaaaagggagaatgtctccagggcatgtcagaatccttcacagcagcctctcccattacaggcctggaggcctaggaaggaaaaatggtttcttgggccaggcccagggcccatgctttgtgcagctttgggccaccgtcctccagaccctagaatggtaggttaaccaacagcttgtgctgtgccgtgcaccggaaaagccacagacactcaatgccagccaatgaaagcagccaggaggggggctgtatcctgcaaagccacaggcacggagctgctcaaaaccgtgggagccgaactcttacatcagagtgacctggatgtgagacgtggagtcaaaggagataattttgggactttaaggtttaatgactgacccgctagatttcgaacttgcatggggcctgtaccccctttgttgtggccaatttctcccatttggagcaggtatatttacccaaagcctgtatcccaattgtatctaggaagtaagtaacttgcttttgatttcacaggctcataggcagaagggatttgccttgtctcagataagactttggacttggacatttgggttaatactgaatgagttaagactttgggggattattgggaagtcatgattatgttttgaaatgtgaggacatgagatttgggaggggccaggtgtggaatgatacatttaggctttgtgtccccacccaaatctcatcttgaattatagtctccataatccccaagtgtcctgagagtgacccagtgggatgtaattgaatcatggggacggtttcccctttgctgttttcgtgatagtgaggagtgagttctcatgagatccgatggttttataagcgtgtgacatatcccctgctggaactcattttttctcctgttgccttgtgaagaggtgccttcagctatgattgtaagttttctgaggcctccccagtcatgaggaactgtgattcaattaaacctcttttcttaataaattacccagtctcaggtatttctttatagcagcatgagaacacactaatatgctagcttaaattagcaaaccatttaaaatcaactaccccaatgtggtgaatcatacctttagcccagatatttcctctgaataccaaggacatgtttcagtgggcctattcaaaatctccacttggatgtgtccagggcttcacatgcttaaactcctggtagatgctattatcatgatcctctttcacatgtagtactccaacagtctcctaagtattctaccttccaatttattatctctgcagtaacaggactgcctttttttcaaattgcaaatctaatcaaacctcatcatcatctacaatcttctacaattaaataacttcacatcactctgtggttaaaagaacaaaaataaaaactttggatcatgaccttcaagtacctgtggcttccccttaccactttagcttcatcttcaactgtttccccatgatttctactctagtcatgctggccttctcatatgcccttgtacttggaaagttcctacctaccatgggttctggaatagtcttctcttcctctttctcttcttattcattcttactttatagatatcacctccatcagcacagtcccagaacttcaccttccctgaattccaagtctaggtcaaaaccactcatgacatcaggtccttctctttgtggttattttattaatatctattgcttcttatgagattttaagtaataatgtaaggaattgtgtctattttttctaaaagttgtatctaatttccaagcctaatgcttggtttatagtaggtattcaatataacattcattggatgaatgaattggggttaatagaaagatgtcaatcattctaaatgaagtcattctaaatgtaacaatcattctaaataaaaaaaattatttagtaatgatgtttaatgaaatcttattactttatttctaaaacctagctagtaaaaaattgacactaaaatgaagagaaaaaacatgttttagaaatatgggtttaaaccaatgatttgaataaagcactggggtaagcaagaaagggttttggataagtccaggataacatgacaagtgctaggtaatttggagatggaggaattctaaatcaaactccacctctttataactctctggaggctcagtttctctattgatgcttacagtgaaacagcatcctttaatagctatattgaatttttaaaccattgagtaatttgtagcagctttctatacaagttagtggtctcagctgtcagtggataagacaagttctactagcttctgtcttaaaacataattttagaaatgaaaattctggaaactgtgtttgatgaatgtaaatatagcctagctgaaactctaagacattggaactctgattctccttgaagagaaattgccatttgctacagagaataaaatacatggagattaaaatatgctgtgctggtgattttaaaaagccatcaagagaattaagttaaaaatcaaagatgaaactgatgaaagccagacccctgtctcattgggtactcctctctagggtagttaagatacctggatggccaaaagaaaaagttacataggctatgttcagagaatgtgaaaacagtatttctgaataataggatctttacaatttttatttcattagtgaaagtctttcattatttcccagtattctgctttcatctataattttccctcagatggccacctacattaaataaaacaaatggtactatagtgtcactgactgagaattgtgaagaatttggggatctagagttggaagaactctaatccaatttagtcaacatcagtgtacaaatatgcacattgaattagattatggttgtcctccaggtggtagcatttaacctctgaaggaggggtaaaatgtgattttaaatgttcaagtattctgggacttcttaaaggctgtgagatattgtgaagtttagttatattaataaagatattggtaatgcatttgcaactatgattttgtagaagaaaccttgcagaaaaaaagatactaagtaaaatgtagatatgaagtttagatgcaattacaaaaattgctcatattaaaatattattgtattaataatgcacccttgtaaagcatggttttaaatgttgaagtaaaacaaattactttttatcatatgaaatagtttcatttttaattgattcctttacactgaaataaatacagcaattaaattacacttaaagatatgacataataaaaatatttcttgcctttagtttgatacgtaggtatagatggtttttaaccttttaaatagtgttcacctttctaactcttgctttggcaaatatggaaaatattaggaggaaatgcctttgagaattactattatctagcgtgaattttaggacacggttagtaatagaactgagcatttaattataagatagctggtgatggtaagacacgagaatgaaaaaaataaccattaatataattatttccaaaatatagagatcattaaagtttagaatctattaataagcatttttactcaaacttcaaatcttatattaattaattttgcctttattctagctagaatagtgtaatacagcagaccatttctgaataataaaatgtggcataaatgaggtgctgccacagcacgcattggattaacagaggataatttgggaccctgacatcttaagccaggataacagacgcaggctacatttaccttaagtggagatgaaaacactaatcattatagccatttgctgttaacagatactttacagtatttattgcttttctccaagaatggcttcataacaaacattataaacacgttgcaggcccacgggaaagatttgcagtcaaatgctgtctcacgctaaattagattaacagtttcttactcgtctctaggccaccccccactttgtatatataccagctcatctcatgtccttagcaaataccgtttatttttacactcagaattataatacatatgccaagatcaacaaatagagagaaagtgagccataggttcctccccccagacatatgataagtattaataattgagtacaacactcctttccactgatctttatctgatcttcatgccaaaacctttctcagtgtagtattccaggaagctactaacaagtgatgcaacctcatatgttgaaacctctttgctattgtgggtctatgccagtactttcaagtctctttgactttatagcacatgtaggtcatgaaaaatgtggacaatactttgcattaacagataaggctgcccataactagagatcatgaatctgtgggttagagaccacccagaatgctcatgagatacgatagctcagaacccacttgctgagctctgactgatcaaggtattggcacagtctatccaaaagtagaaacaacactggcagggcaggatctgacatcaagtaaggttttctttattctgtatttgctgtgagtgttattagctgtcaagctgtcttcataattgtaagacagttcacaacatcataaaaaacttattttcccaagccatggattaggtctttggattcaattaatctgatacaggtatgacaaagcattctcttttcaaacagtttatcttagagatacctgcagaatttctattagcatatatttccgtctactctagtgctaatgatcccattatctggctatgtgttactgtaattgaaattagctacagttatatccatcatcttagccctcatagtcacagataaacaatgtggatttatagcaattctaccttggcattgaaaaggtatccctttcagtttctgccttcaggtaaaatgtatactatgtggcttactatttctgatgtgttgattctatacccttttgaaacattttttttttgaaactagtattttggatctgatattaaaattcgttctgacctcaaattcatttgcattacagtgtaatatttcctccgtaatttatgtcatatatgatctagaaggggaggtatgtattaaaataattatctcattcaatgcagataatagctttaaaatatatcgacatgcttttccttataattttttgtattcagcttgagctcccctcccctgacaaagagccacccacttatttcctgaaagaagggggtgggtgggtatattaagattattataacaagaaagcaaagacagatagtttggtttttagattttggttcccaaaacagggcacagtggtcagatgtgggtatattggcttcttcctctgtatggacacactacagaggagagtttggcagtattctcagagcagggaaagtctgacagtagcctggggaaatggaaataatcataaagattccccacattagcctaactctggagcgacaaggtgccacacaggcattaagttaggaacgcctgagaaagacgtcttgaatctgcatttaagggcagactctaaacaaccctattcattacagattgataggaagaaagtagccaagatatttttaccagacccctaagggttgggaaaaccagtaaatcaaaattagtctgggactgatgaaaagaagccacaaaatacagagatctcacagtcataggccatggcaggaacatgaacttcagcaacatatatctgcgtggaggacaaaattttgtaagaggtgcagccgcatttcagtgtgcgctgtcacaggacacgaacagagacacctcactgaactggagaccagtagatattcagagcacattctgcagttcacaggattcttccctaagatactaactttgaaatagagaatatggcaggcctactgaaagcaggaaagagcatcctgataggaaatttgaatgttgtattaaatccgaagtgtcaggtctatgtgaaacaaacaccagataaaaacaaaataagacaaaaactatttcaacttgaataaaacaaatactttaagaaaaaaatcaattgagctataatttacataccaccaaatgtattcattttcagtgtacgattcaatcatttttagtaaatttacagagctgtacagcccttaccaattccgatgatgaggaggggtggaatgggggcagggaaattaacaattaaaagtaactcacttttacaacatttcaatcactttattatacatacgcatacagttatgcatatatacacagattatatttatgaacatttatatatatataaacataatgaacctcttctataaaaaagtgtttatttttcattattttatcaattatttatataattcattcatttaatgatttttatattgagaaatatggagaacacaaagtagaataaaattgtctttctgtttaagaatttcatagcttggtgtgaaagatagtcacgaaaacaaataatgacagtacttgatgaaaagttttatgacagatgtattccctggaattatttcatctctttcatactccttacaaccctatgaaataagccaagcatatgaatatctacattatatagataaagactctgtagaccacagcagttatagtagcaaacatagtgagaggaaaaaacagaagttaattctagattttttgatacttaaaacattcacatatatttggccttaaagacagtagattttctctaccgaaatgtaacccagtttttataaatgttactgaggcatgctttttttttatttttgtggaatttgttattatttttcaacctacaataatctattcaatacccactctgccaaataccgtgctagccatgtggcgcctccaggattagaagttcctttgctgttatcagttcttatagagtgatgttgaattgtaggaatgtgagaatttggcctccttactgataagaaagactattaggaaactttccaacctgttggaggcaaatgagcgttaatgcaaaagttgacttagaaaaagctttattctaattccagcttggccatattctagttgcgtgaatttcagcaatttgctttgtctctctaagccgatttttgctttacaatggggatacaaataccaacctaacaggtgaaaagtaaatgttatataataaaagtgctctttatagtaccttcctcataggaggtacctcttgattatttttaatgaatgcattagtacacctaaatcacctgcatatatttctgaaccctctaagcggtatattgtgccttgattttttaaaaacataataataacctgtaatcctagcactttgggaggcttaggcccagctattcaggaggcttaggtgggaagagcacctgagcccagagaggttgaggctgcagtgagccatgattgcaccactgaactccggccttggtgacagagtgagaccttgtctcaaaaaataaaaatacaagtataaaataatgatgcaatccctgccttctggtagcttacatttgataaattaagctgaaaagaattgtgggtatgcaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaaaaaaaaaaaaaaaaaaaaaaaagaattgtgggtatgaaataggaaacaagcagacaagttacatgagtcacttagaacttgagttcttcttataatatgggttcaaattacctgttgccaggtttaaggtgaatcgtttaccatactgttttattttccatggtctaaactgaaatgtatgcactaaggtcagagaaccaaatattagctttaattacacaatagatatattagagaatgccacagactttttactgttttcctacaagtctaaaccttggcccctacatgtggggataattgggtctgcaatctagttgcttgcataatcctagcttgccttacagtgtagtgagagctccaggtaaagagcacaagtgagcttcaacatttattcattttcccctcgcactggggaaactcgcaccaaggggttagagtcagattcttgccatctaacaaatcagatgaatcactcctgctcacatagggagaagcttgtgagagatagaggaagagcaacaatttctacctacagaaattattttacagcctgccattaggtgtccaaggagagagagagaaagtttcactctacacatctgaggtagaagtttgataagaattaaatgagggtgtatataaaacaccgagaaaactgccgcccctatattacctgctcagtcaaaggtaatatactctgatgtgtacacaatctacatttgcaggaagaatcctgagacccacagcaaatcagcaatgctcctcatgggagaactccaaatcataccccatctctgactcttaggacctttgataagatggttatcttatcaaagataagaaggggaagaaggggttgctgtgggctgtaggaactgtgagggcctcagagaagtcatattttgaactggtgagtcaaaccttgaggagaatgttaacataaagagcttctcctgtctccgtcaagagacataacctctccagtctccgagctaattcaggggcttgaacccatggcctttggtcaacttcgagctctaatatccagaggtggtatttgtattgggttacctgacaatgactggactaacttcctcctccgacacacaccagcaggtgactgggcctccctaaacacctcatgattcttcttccacagcctggcttttgagtaggacttattccacaactgaacagttggaattgcttctgatcatatgtgctgaactgcttagcatttatttaattctcatttcttactgtgtccttaaatctctcgattcttaactagaaaagtggaagtcaagagggagcactactttgattgtctccacccatttcaaaatgtcaggaggtaataaagggggctgtctgaaacctgaggagcttctgtactgtttctgactgagaagtagggatcagagctgagtgtcaggtatgaaattattttcagtctctggcttgctccagcctccaagttctgttcacgtcatgccttctcagactattaacagaaggaaaagctgaggttgtttttattgttctttgttttgtttttttaaaataaagtaaaaacagaatgatcagaacataacactgctgctgaatgcacaaggaaccatcttatcaaaggtcctaagagtcagggatggggtatgatttggagttctcccatgaggagcattgctgatttgctgtgggtctcaggattcttcctgcaaatgtagattgtgtaaacatcagagtattggctgccacagtcagagggaatgtaggcatttcaaagagttttcagtttatgcgtcagcaattgctgaaaactcacccttcaaagtacagatattactaatgccctgtttctgctcttaattgctaattatacaatctgtgtaaatgcaagatatgtgactcctccagctctgcaaatgtctttgcagctgcctgtacactcaaattaaagcccaatgcagctgtcctagaggtagttttatgtgattccctgaatggacaaattctattttgaatgctgttaggagtctctccctgcaccactcaaaagtcacttacattacggttgctttcttcctgttcagcatgtcttctcttcctggatgaagtgagaaattgccattttgctgttccttgctcacttaaatgtgagttacacaagcctttttaaaatttcatttcctctcaggaaatgttttaaaatatataatttatttcttttggtacccatccagaaaagtatatttagctctttttaatgcattgcctatatagaatgtgatttttttcttgagagccttatttcattgagtacaaacctccctttatatttctagcacattaatgttataaaaattagtactttcccgtaccctgaggaatccaggtgtcagcaagtgttaccaaaacttgggcatatgattaattggcttgagcccggatgacacaccctgtggtagcctaacacactcttcaagacgttcatcagttcacggagatattttaatgatcaccactgacatgggaatcttgctccgatgagtcctgtctctgttccctcatagtatcaattcaaatacataacacagcttctctcttggttttcataaaacatgccacaaactctttggaaatgtagtcgagtttattcaaggtttgtgaaggatagagactgaggaaagaatttgcattttcaaagtaccaaaaagcttaatttcagtattagatatctgtattctaaaaacgctcaccaaccacccgtctctggagtatttgcacagacactttccttccatgcagtttctaacatcacaccatcatgccatactggctactttctcttctcttcctcttcccacttctcataccctccatccagtactgcatggagaaatccaaattctttgcctcatgttaggcagatgtgtttgtctctctcagccttgattctcaagcctgcatatccaaacccatacagctacacagacgtgaaaaatgaatttctaagtagaaatagacgggattcatctttttagaggagacttgtaggtacaaagaattatttttctttcactgttatacttgcatcaactgtttgttgtgagttcttttattcattcaacaaatacagctgtcctctcattctctgtatccactgatttcgcatctttggatacaattaaccacaaattgaaaatattttaaaaccccaacaaaatagcaattacaacataaaaattatacagataataaatgatagagtacaataactatttgaatagcatttacgttgtgttagacatcatacgtaatctagagatgattaaagtatacaggagaatgtgtgcaggttatttgcaaatactataccatttcatataagggacttgagcattcctggcttttgatatccacagggatcctagaaacactctcccatggataatgagagatgattgtattcttttaatgcctattatgtagcaaatttcaagttagcacttgttctgggataaatttgtacctgttaataggagacagtataaacatagtagaaggaagccttagacacagaggaacttgattctagttctgattgattcatgctttcactttttctttccaaaaatggttgatgtaacctactctgtttcagcaagatattagatacagggaatgctgaaattatttagagcccctactctcaaacattgtagaatagagtaggaaagacagatgtatatgctggaccgtaaactgagcaatctgacctttatacaaatcaaggttgaatgtgtctttttttttcagagcctgtgtttacttttgactagcgaagagctttcagaaaattaatgttttctcaaatgaaatcgattggcagaaatcagagggatagaggaaatttattcaatgcagagttgacttaaactgcggtgaatgtttactttctggggtcaaaaatgcatgtaccggtttcttttttgttaacatttaatatttcctgttattaataaggaaatgttgcacctgaagtaaattaaatcaagatggaatgtataatttctttgaaaacaataaaattgttattgcagatgttattaaactattagtcaatgtaattttgtcaggattatgtactattgattaggaaataacctgatgaatcatttggaaggatgctttttatttttagctttgactaacaggagtgtttgacagaagcaagttaaaatagtgtgttatactgctacagctatgtgaatttacattaaatgctttatttcagtattttagtatttgctgttaataaagaaaattaggaatctgaactcattttagttggcctttgaacactttgagtttatgagtttgaaaacaacttcaaattaaagatacattgtgatttcactggggaactttgggtctttaaaaattcatctgatggagcatggtgcagttaggccaagtttgcaaagacatatgaatctggatcatatggaccaaaacatttgcttctcaagtaaaatctagctagtcccttttttccatgttacatatgtctgaatttaaattccctatgtcttccatctcgaagataccaggttgttttttttttagctctgaattgtttccacccattatctttttaaagaattcttcgattgtatttcccttttattataaaagcactgttttataacttttacataccaatctgtctccagtaccaatactacctcttttatgaacaacctttgtttagctgtcttattcacatatgtacctatgtgcctttgcatattttcaactctcaataaatgctttttgaatagaattcccatagctaattaaaagtgtcagctgttaaaatggacttcacacttctttctcttgaggtgaacaatgcacactggggtctgagaaggtggtttcttaatctcttactcttagcaggatacccaccttttcttaagtgcattctaagtttctggagatatataggattgcagtccagaagctgtgctgtaactaccaattctccttagatttgagtgaggttaacagagtaaaaacatgatgttttgtgaatgcgccttctgtatatatggcacctttctttatcttcagataggatcagtgttagtagatatgggttttctgtgaagataattaaaagccatataatttcacaggtatatatttggagaggttttaaagaccacatgtccaaatatataagcttttgtttccacaaagtctggatccactccttgtgattagccccattttacagttgagagacattaaaagattatgactgatccagaattccagagcaatatattgagaaaagtagaaatagtaccctgattgacgcttcttagtttctaggagagagaaaattacatgaaccctttacaaaaagaagacagaagataaaattcagaatttatatcaaattatttggctctgagtcaaatttcatctgcaagaatattatgttccaggtgtttgccattgggacaatttaatgtgtttaattagaaaatatattttaaaatattactaggtcgctcagctgtcaaaattatgtaaataaaatggtaagtgaaaataattataaaaatatttaaatgtccttatatggctttttaggaaatgtgcttcattttctttctacacaacccaaatgtccaacagtgatagactggattaagaaaatgtggcacatatacaccatggaatactatgcagccataaaaaatgatgagttcatgtcctttgtagggacatggataaagttggaaaccatcattctcagcaaactatcacaaggacaaaaaaccaaacaccgcatgttctcactcataggtgggaactgaacaatgagaacacgtggacacaggaaggggaatatcacacactggggactgttgtggggttggggaagggaggagggatagcattgggagatatacctaatgctaaatgatgagttgatgggtgcagcacaccaacatggcacatgtatacatatgtaacaaacctgcatgttgtgcacatgtaccctaaaacttaaaagtataataataataaaaaaatacatttttcctgggttcttcgggaatgtgattgttatagttacaaatgtatgcatatttttaaagaaaataaggttgagtttcagcctaggcaaactgctgaacccaaaaatcactgtgagaattttgattagtattctgtagatggttttcagtctatttttgatattttagcttagacttttgaagacagttgagaaagcattttttaacaacgagaaattcattattcctaaattaaaagataaagagtggagagtagatgtatggttgacattttacaaatcaaatactttagagttaataatttctacctgacactctatgtaacacagcattcagttgatggtaatttgttatgtttactgatcactattaagctattaaatgtttttaaaattaattattttattattttctgccatgctaattgcttaaagaagaagagcagtgattggagtggtgaaataaaacaaaataaaacacagacagtttattgtcataatatttctaaattggaagtaagtatagccgaatgcctcttatacaaggagtcagaagatctgcagttgttttcacatttaaaaacctcagcatccttgcacaaatcacgttgcttttctgacttttcaattcttcatctataagaataaatatatattactcttaccttatcttcatagcttttgttaatatcaaatgagtaatggaaatgaataacctatacaattgtaaattaataatgatgtggttgaagacgattcaaggaaattttaacagtctgtgtagtgatccaaatttggctattctaaacaattttctaatatttaaattgtaagccatgcacatttcatgatttaaatatcaatcatatgtccacttactcagctaatatttatttagcacttactgtggaccaggcaccatgcaaagctttaggggctccatggcccacctacaccgcacatgatcatcttctagtggaaagagctggagagtaacatgtgtgactctcatattatctattttgctagaaaagagtatgaacatatatgtatacttttatatcttattgtaatatcctctaactgaaaaatttatccagtagtttcttctctattttgtatacaggtctttggcctcacatatgtaggacatggccccaggagtttaataatcactcaactgagtatgttaattaggaattaagtaattgtattaacaattttttgattgaaactagattgagagcaaaaattatataactatgtgagatcaccaaacacccagagaagtcctgggaataacagtagttcagtaaatgtggaatttgcattttaaaaaggaaacttgtctgaggcaggcggatcacctaaggttgggagttggggaccagcctgaccaacatggggaaaccctgtctctactaaaaatacaaaattagcgaggcatggtggcgcatgcctgtaatcccaggtactcaggaggctgtggcaggagaatcgcttcaatgcaggaggtggaggttgcagtgagccaagattgcaccattgcactccagcctgggcaacaagagcaaaactccgtctcaaaaaaaataaaataaactaaataaaaaggaaacttgtttatataatgaagtacttagaccctgttatttttgccctgatatattttacttaaaggaactttctaaatatatacgtgtgtgtgtgtgtatatatatatatatgtatattatatatattgtatatatatgtatattatatatattgtatatataatgtatattatatatattatatatatatgtatattatatatattgtatatatatgtatattatatatattgtatatatgtatatgtatatatgtatgtgtatatatatacacatatacacatatatgtgtatgtatatatatgtgtgtatatacgtatatatacatatatacaatttttgtatatatacatatatacacatatatatgtgtatgtgtatatatatacacatatatgtgtgtgtatatacacatatatatgtgtgtgtatatatatacacatatatatgtgcgtgtatatatatacacatatatatgtgtgtatatatatatatctcccttttcaaccatattccactatctccaaacagtatgtttaatatagtcacttgttctatcgagatccccactgttttcttgttacagcaatgtacataactctatgtgatatggagcacagaaatttataatgcttgttttcagtaaaagtggagaaagaagccattttagggtatacatagcactaatcacaatgcctaaataacttcataataaataacatataaagaagaatgaaaaggtagaagaaaagaaggaagtgagggaggaagggagggaaagagagaaaggcaaactacagtggtgtgtacagaggttcattaaatgatagaaaggtaaacagtgctccctactaaatcttttcattctagtctcccaaaatattagtgtggcatcagccaatttcatgtctaaaaaactgtctcagtttattactaatcacaccaagaagcaagtgtgttaataatttataatctatcatcgagacaagcttttactgtttctaaattatttaaaatgatctgttttctttgtctgcctgtttatttaatcaatttaattcttatatattgttctatttaaaacttcactagttgacatttagtcatttgctgtcccaagtttgagttgaaggatggaatttttaatgagatcctttcaatcattcaacaaatatttttatcacctatacttctggatacttagcatatagcagtggaataaaacggaggaaaaaaaaaactattattgtcctcattgaagttatttactagtaggagaagtgatatggtttggatctgtgtcactgtgcaaatctcatgtcaaattgtaatacccagtgttggaggtggggcccggtgggggtgattaaataatgggggtggattttgcccttggtgctgttctagtgatagtgagtgagttcttatgagatctggtcatttaaaagtgtgttgcagcttccccctcgtctctctttctcctgctccagtcacgcgaagtggctcactccctttatgccttctaccatgactggaagcttcttgaggcctccccagaatcagaagccacaatgcttcctgtacaacctgcagaaccatgagccaattaaacctcttttctttataaatgacccagtctcaagaatgtctttatagcagtgcaagaatggactaatacagggagatgtacccaacggatgaacgagtgaaatatttaaaatgtcagaagaaaataaatactatgcatacagatgaacaaagtaaggaagatagcctgtgacaatggagtgattttattttaagtagggtggccaaaggacgcttatttgatttaatatttgagtagtgacttgacgaaagtgacaaactgacacatgcaaatatctaaggtaaaaggttacaggtggaggacacaacaatgactaaggctccaaggtgaaaatgtacttggaatattgaggtaagtcaaggagtccagtccagctggagctcagtaagcaaaaaggaaaaggtaggaggtaaagtcaggaagtcagaaaaaaaattatatatatataggttattataaagacattgtcttctactgaatgaaagtggaagccattgaagggtttggaatataggaatgatagaatctgacaggatctgacttttgttttcagagacaaggtctcactgtgtttcccaggctggaatgaagtggtgtgatcataggtcactgtaatcttgaactcctgggctcaagccattctcctgccttggtatcccaaagctctgggattataggtatgagtcaccatgcctggccagatcttactttttaatgtaatgattctgggatttcattcaagatagactaaagggtggtaaagactgaagtaaggagactagtgaagaggctatagcaagacatggtggtgacttacaccagtatcataactgcagaagtaatgagaagaatttcctaacactcattcttgtatatgagacacacacaatgtctcgaagatgacttaaagagttttgccttgaggaaatgaaaaaatgtagttgccatttaataaaatatgtaaaatttcaggaggaataattttctggcattttggaatggaaatcaggagttggtagcagtcatgctaatgtttggatgtttacaatttcataatgtagtctctattaaccttacaagtcctgtggtattgaacataaatttctattatcctttagaagcttcaaagcactaatattttataaccattaaatttttacttgaaacattttggatcaaatttcttattgtttttgtttttctacttttcacatagaactcaaaaaatggacttttaaccttggtagtaatcagagggagtcttgaatttgaagtgatgctaaacacccacacttcatttgcatttatttactgcctttatttttgcaatttttaatttcataaagtgtctcaggacttcctataaaggtgtacgtataaaaatagtctcatataatcacaccttgcagagataactattgttttcattcatattctttcttatcactccataatccattcacaactcacacttgtgtatttattgtgagaatgttatataccaggaactgtactaaatgctttacacggattggctagtttaagtcatacaacagccttttatcagtcatgttattacttgcagataatgaaaacaaaccacgtagtttacacattaaaaaaagtattaaagaatatcaacttaaagatttcccagaaattgcaaatcatgctgaggtgctgtacagatggacaatgtccaagactgcaggacatatttggtctgatagaaaggtcacaattgcttctgcgattcacagacaatgcatgtgacaccaccaattctcctagcactggacactggatattacctctgaaatgtttgcatctgctttccatggacacctatacatgataaattttcttacaatagagtaagtgtgttcaaattctgggaaaccaaaaatactactggaatggtccacgtcttagactgcccaataccagtgtattaatatgtactcagtaatagagactcagataataaaaccaacccctgataagcaggcaaataggaaagcaagactaatttattgtctctgcaaaagagggtcatccaaatagttattatttttatgttgagctgcagctctcatcagcaggtgattgtgattcttctataatttcattacaatttacctcaagggactaaattgggaaggtcaccaccatcaatgaactcctttttaaaaaattactagggaaaagagagaggagaaacacacaaacacacacacacaatagttagcatagccaatcatatacaagaccctgcacagcatccatgctggcaagggtggtggcagttacctccagtattcaaaagcatcaaaaatacatagttattaggttattaaacagaaataccaaaatttatgataagcactgccgaggagtgggttatatttctagctctgaaatctaggatccatctcttacgtgttctgtgtgctggggaaagttgcttaacctcactagccttcagtttcttcatctctaaaatagagacatcaataatatacctatctgatagaactattattgtaataatatgaaataatgcatgtgtcttctattcaaatgtaacttgtttgtgaattaaattacactatgggtacatctgattatctgactggccctgaagaggaccatgtttggctgctcttgcgagtaaatcagtaactcaacagtggcagtagccaaatgagtgataatgaggtgaagtttcaacagcagaggttgcaatactttacgtgttgtatataactcaggattctttcagcaaaagaattgttatgactataaaaactaagaaaacaaatttaaaaatagttttctagtggaaaaatgcaaagatatactttatatctgttttgtttttgtagcatatataatagagaagtagtgtgggaaaggtcacacattgatacagcagaagcattggaataataattatgtctagcaattagcaaacatctatcatagttcagatactatactaagcactttacatatataatttcgtgtaatcaacatagcaatttttgaaaattgtggaattgaatattagagaatataagtaccttgccctaaagtacacaatttaaaatggccatctaacttctatattatcgtggtaaatcaggcacttaatgatcagatatgtaatatctactttctgccatagtgcattcctataaactgcaagacaaagcaaataattgtaaaatgaatggtattttcacaaagaaacaatgccattattgaaaattgtgttcttaaccaataatatgacattgaagacatcatgtatatataatcaagaatatgtcataagaacaaagaaaccgtgaccataaaatgtgctaaatctgatagatattaattaattatgtatttgatgagtaataatgctgcttctcttttttgaacttaggatcttgaggaatattttcagtggcttttatctctaagaaaactctcaagtggggaaaaaaagcaacttcaaagctttcttctttcttgataaatgtcctttacttttgtagtcatttagaactactccactgactatctttttaagttgctatgatagcatctaatattggggaaaaaaagaaaaaaaaaagctttgaatgtagtaatgtagaagacctaatttctaggttcgtctctgctggaaattacctacaacgcccaagcagtagtgcttcttttctgttcctgactttctccatttctacgaagacactagatttggtgaactctaaaggctctttcagggatagaactttctagaaactggtatagagtacccagtccttggatactgatctaagttgttggagagcagacgttttctcagtctggttctgttgactattgattcttatttgtctgttcttaccacaggatcaaatcatgaagggaatctcttccaggttatatgacttgctttggtcataactagtgtttacagacacatagtatgatatgtcatagtaaaataagaaggaatctagaagttttgaattcaaatcctgtttcttcatttactgagtgaccttcaactaagtcacttaacctccttaaacctagaatttcccattaataaaacagaggggatagttcttttcctacagggtaatgataaaaattatgtaaataatgtatgaaaacatcttgtgtgtatctatctccttatgatagttataggctgatgtagaaagtcaaacccacgggcatcttgataatttgttagaaagccactccctaatgggacaatgtgcctagacaaaagagtttggaagtaaggtagagatgctaattagctgtcaactgattttgaactgatcaacataacaaagcttaaatagactctattgctattatcagtgcctgttaattcactcagagtatgtgagcaaactataaacctgcaaaggattacagaggatgcttagcgcagtgaagccctgtactgaatgaacaaataagcccccagggaagcttttaaaaattaccagtttctagagccggtccctggacattatgattcaatagatgaagtgtggtggctaggagtttgcatgttaaagaatcttcgtagaatatcaatgaacagccaagattgagaacacctgaactgatcagattcctcattttacaagtgaggagtatctggcagagggaggaagattgagatcccaaagcaggaacttgaaaaaaagttctcctgatacttaatcctttgttctttccataatatcacatggcaaaagacagatagtagagtcagtggtatttcctgcaagccaggaccattgtatatggtatcctggctgtctatgctgaagtcaggtttatgttctcatgcacataatgtgagccatggagtgctggggccatttgtcagagacaaccttctacaatgtcacattaccaggttgtcaatagtgtacactcacctgaggtaggctgccacattaaaatgggacacaatgacaggggagaatctagatgtaaaattgaaagagtcagaaactgcccacagtcagaggaagaaataagaagtggaagcctggaggcattttctgatattgccttggtgtttgattgtgattctgtttctaggcatagcaaaaggaaacaagactgacttgatggtcaaggtgatgtaagtagatcagctggcttccccaatttttttgaaaccaaaaaagtaggcccggcacggtggctcacgcctgtaatcccagcactttgggaggctgaggcgggcggatcacaaggtcagtagtttgagaccagcctggtcaacatgatgaagccccgtctctactaaaaatgcaaaaaattagctgggcgtggtggcgtgcacctgtagtcccagctactcaggaggctgaggcagaagaattgcttgaacccgggaggcggaggtttcagtgaaccaagatcgagccactgctctccagcctgggcaacagagctagacttcgtctcaaaaaaaaaaaaaaaaaaaaaaaccaaaaaagtaataggtttatatgtatagtaactaacatattataaagttcattaccagaaagtttatatcttggtcaaatatatttacctaaaaagtggaatatgaatattaagatacagtattaataaagtcattaaaactcatgatttgagagaaactagatctgtagttagaggcaacaacagtttattgcatggaaaaatctttccaatttttagttctggttaaaatccttctggggtagcggctttttgtttctaactttaaaaagttcccatacacaatcaattgtactattttattcattttgaaatgtttgacagtggaaggactgggaattgaaagactttgattgcaatcctgacttgccgtggaccaatgtcatgaccttgcagaagttccttttccctagactggtccccattgtactcactggaaagacatgatctcaaagggctcttcaactctaagagtcagtaagagcaaaggtttgggcagagatgaaaataagatagcagggtgcatctgggaggtggaggatggaattgaatctgatcccaatgcatctgtggggatcagagctaaaatcaataatgtatgctgttgtttctttttatctttttttcttttttttctcctaatgtctttccccatcttttcctgcctttttaatattatgtctcctaactctagctttaactcctgaattatattaggattttgttaaagttcatacattttaagcaaagagatgtagaaaattgttaaggcttaaaatgaatttcaacactcagtaattgcatatcctctgcttcctactggaagagaaagaaacttttcgtggactggagggcaggagaatgagaaaaaatgtgttttcttcaaatttctatgaaaatgtgacagcattcatagggagacaaaaaaaataaattagaaaacctgataatccttctggagcagtgctttttctttcatgaaaggcattgtgaatcttcacccatagaaacattttgagcacaattgaatgcatttgtaatttttgaatcctatatttgaaaaacatttgaaagccaaagtactaaaatctaaagaaaatgcttttctatcggcctcctatcatatttttatactgtgatagttacataacttgaaacatggtgtttttaatgtagtattctcaagcaattgtttagggaacaaagactcaccgtatggtacactggaaaatacagcagaaattttgaaatcagaacaaactggactgcaatctccctcccacttcataggtataacaattttggaaaatcactaagctcctagttttcttacttgcttctcgtgaaggtagagtgtaatatttgtacaagctctttatgaacaatacaggttacaagagaaagggaatgtgttgccagccaatcagctcctcaaatgtgctttcattgggtggcaacatctctaatgtgaaattgatattatctatatgtgattactaagatcatgacggaggtgattcttttgaagtatcctcagtgcagggtttggcacagactagttactcaatacatatattctagccttttctttttttgcttacacaacgttaacttatgggtataatagtttaattatcacatgatcacacttgagttgttattcagaataattttgtcctcagcaaataatcagaacattaataggcaatgcagatagagagtttatgagtgaatgacagcaactggcccaacttcttcagcactaggtttctaataattcaagcctgcagattgtgctgtatttttattcatttgcactgcaaagttttttttttctgttaaatccttgttatttggccctgcatcatttcagtaaaataaacttggctccatcaaattcattaggcaagctatgatgtgggaaaagtcaaaatttatcttccctgaagctactttcagacagtaccttaagctgggcattttaaagtggtgtcagataaacttggcagccgtttctttccacagatattcttagttgaagcttttggtctcttcttcactcatgggatggttcctcttgccctggttgcagaatagcgttcgagcagtgaggattctcagcttttctgttttacagccctagagacttggctgctgcagctgggtatcaagcaatgattttcacatgcctttttcatcactttttttctaggagaagattgcttttgacattcatttttaagttacatgtcgttttccaagagtatatctctcacaaaagctttagaatgccagtaataaatgtattagtagctaagaagctcagtctggcaactaccttgtctgctttaagtcagtgtgaaatacttccaataatttaactcttcttaaacaatcacttgatgtaatatttaaatctaaacattaaaatcttctgtggtttttgatctgtattagttcagtactacatagattaaatatttgatatctgtacctgaatttgatctatactcagccagcaggagaaatcgaagggagcattagatactcgtttatttatttattttaatttattctgaaaaatgattaacttacttatttgtcagaattgattgtttaaatgaattgacttgattgtactcattttttggtgttcggttagaataccctcaattgacagagtcactggtccagcagcttacaagtataatcaaaatggctatcttatgtagaaaaggcagtaaaggaatgatattcactgggaggccccttgtgtaggtcaggaactatgttaattattacatcttatttcatttaattcttgcaatgatcttaaaaggtaaatattatcctaattttcaaaggaagcattggaagcagagagtatgagtaacttctgcaacactctagagtcaggattcatacttaagtcagactccagtctacaggaatgggccacaacaccaagctcctcaatgacttgttttgctcttgtcctatcttttgtgcacttacatctttatcactatgttcaaaactaaaatacaattttagtgcttattttatccagttttattttttcaggttaataccagccacagagcaatttagattccccatctccctttgaaaaatatacaattcaataaccatacatgtgcatgtgtctttataatagaatgatttatattcatttgggtatatacccagtaatgggattgcagagtcaaatggtatttctgggtctagatccttgaggaatcgtcatactgttttccacaatggttgaactaatttacactcccaccaacagtgtaaaagtgttcctatttctccattgcctcaccagcatctattgtttcctgacttttgaataatcaccattctgactggcatgagatggtatctcattgtggttttgatttgcattcctctgatcatcagtgatgatgagctttttttcatatgtttgttggctgcataaatgtgttcttctgagaagtgtctgttcatatcctttattcactttttgatgggtttttttttcttgtaaatatgtttaagttccttgtaaattctggatattagacctttgtcagatgggtagattgcaaaaatgttctcccattctgcaggttgcctgttcactccgatgacagtttattttgctgagcagaagctctttagtttaattagattccatttgtcaattttggcttttgttgcaattgcttttggcatttttgtcatgaagtctttgcccgcatctatgtcctgaatggtattgccaagcttttcttctagggtttttatggtttggggttttacattgaagtctttaatttatcttgagttaatttttgtataaggtgtaaggaaggggtttattgcagcactatttacaatagcaaagacatggaaccaacccaaatgcccatcagtgatagattgaataaataaaatgtggtacatatacaccatggaatactatgcatccataaaaaggaatgagatcatgtttttcctgggatgtggatgaagttggaagccatcatccttagcaaactaacacagaaacagaaaaccaaacactgcatgttctcactcataaatgggagttgaacatttagaacatatggacacagagaggggaacaacacacaccaggacctgttggagtgtggagggtgaggggagggaacttagaggatggatcaataggtgcagcaaccatcatggcacacatatatctatataacaaaactgcatgttctgcatgcatatcccatttttttagaagaaatgaagaaaaaataaaataaaaagactttaactcagcttcgtatcctcaaaaaagagaaaaatatgcaattcaaatttccctatgtacaaactaaattcttaaaaaagttaaaattttgtcttaaattacaaattataaatgtaaatcttaaattataaattcttaaaaatacatgtcccccgtagtgagaaagagctgcagttaaaacagtggttagcaattcccagtctagtagtctaacaaatagataccttgtacattcagtgttttattttgcttttcattgtgttaaataatttttactaatattcacagatttcaaatgaggacaatttaaaaatataattagctcagagcagaattccacaaaattagtccttcatgcttgaactgagtgacctgttcatgtactaacaaatatttcagtgtccatctctgaagggcaagatttcaagtctcaaagcttctcacattgcatgtactgagaaactatactcctatgtgattgtcataaaactgaatcctaccaatgaagacgaaatgataagaaattcataagtcctcctcagagacagaaagtacattcccacccttatcacctcccataattgttaaggatgacaattattatagttatatttattgaactcatactatgtgccagtaattgtgctaggtgctttatatacaccctactggctgcctttttaggaggtattagtaaccttatattctttgattcagtaatttcaaatgcggaggcttacaacatttgtcattcaaaaaaaatcactcactgactctaaagtccatgtttttgtcaccatgttgtagctgctccatttaaataaaggtgaaaggagttgagagatgtgtctgctatgtacagcatctgagattaaagaaaagaaaacaacagaacaactaagaagtgtccttacattttttttattcagaatcagaatcaatcagtgatggtttgtaaacatctacagatatgttttgcttcttttgttattacttagggtgttgagagttacagtttatagtatcatgtctttttttttaaagaaaaaaacaattctgtctttggaaaaaaaaaatggaaacctacttatagtttaaaagggtcatttatatcaaagcacatagagccagttcctgagaattttcactgattttgtgtatgacttcccagaaaagccttgtccattccaataggtgacataagaaaaagtgatattctgacattttctatttgctatagatacatgattattaaaataaattcatattgtattcaatttttaaataatttggtaatgtcatttaatgtcagttagttaaatcatataagcttatttgtaactgttccttatattttagaaatgttaatccattattatttgttctttttacttttgagggttttatttaacttttaagttcaggggtacaagtgcaggtttgttacataagtaaacttacgtcatggggggttattgtgcagattatttcatcactcaagtatgaagcctagtacccattagttatttttcctgattctctccctcctgccaccttccaccctccgataggcccgagtgtgtgttgttcctccctatgtgtccatgtattctcattttttcactcccacttataaatgagaacatgcagtatttggttgtctgttcctgcattcgtttgctaaagataatggcccctaactccatccatgttcctgcaaaggacatgatctcattccttttattggctgcatagtattccatggtctatatgtaccacattttatttatccaggctatcattgataggcatttaggttgtttccatgtctttgctcttgtgaataatgctgcaatgaacgtacacatgcatgtgtctttttaatagaataatttatactcctttgagtatatgcccagaaataggattgctgggatgaatgacatttccatctttaagtctttgaagaatcaccacactgtcttccacaatggttgaactaatttacattcccaccaacagtgtataagcattcccttttctctacagtctcaccagcatctgttattttttgaatttttaataatagccattctgactggtttgagatgatgtctcatggtggttttgatttgcatctctccaatgatcagtgatgttgaacttcttttcataggattgtgtgggtcacatgtatgtcttcttttgagaagtgtctgttcatgtccatcacccactttttaatgaggtgggtttttttttcttgtaaatttattaactttcttatagattcaggatattagacctttgctagacgaatagtttgcagatattttctcccattctgtaggttgtcgggttactctattgacagtatccttggctgtggagaagctcttaattttaattagattccatttgtcaatttttgcttttgttgcaataggttttggcatcttcctcatgaaatctttgcccatgcctatatcctgaatgatattgcctaagttgtcttccagggttttttttatagttttgggttttacatttcagtctttaatccatcttgaattaatttttgtataaggtgtaagaaaggggtccagttttagtcttctgcatacacacaatcctttccccattgcttgtttttgtcaagtttgtcaaagatcagatagctgtgggtgtgtggtcttatttctgggttctctattctgttcctttgatctatttgcctgtttttgtacaagtattgtgctgttttggttactgtagctctgtagtgttgtttgaagttgggtagtgtgatgcctccagctttgttttttttgtgtgtgtgtatgtgtgtgtgtgtgtgtgtgtgtgtgtgtgtgttttgcttaggacttctttggctattcaggctccttttcagttccatatgaaatttaaaatagttttctccagttctgtgaagaatatgaatggctgtttaacaagaatgtcattaaatctataaattgctttggatggtatggtcattttaatgatattgattcctcctatctatgagcatggaatatttttccatttgttcgtgtcatttatgatttatttgagcagtgttttgtagttctccttttagagatctttcacctccttagttagctgtattcctaggtattttattctttttgtggcagttgtcaatgtgagttcatacctgacttggctttcagcttgactgttgttagtatacaggaatgctcatggtttttgcacattgatttgtgcatactgagactttgctgaagttgtttatcagcttaagaagtggttgagctgagactacagcattttctacagatagtatcatgtcatttacaaacagtaagagtttgactttctctctttctatttagatgccttttatttctttctcttgcctaattgccctggccagaacttccaatactatgttgaataggagtggtgagaaagggcatccttgtcttttgctggttttcaaggggaacgatttcagcttttgccaattcagtatgatgttggctatgggtttgccatatatggctcttattattttgtggtatgttctttcaataactagtttattgagactttttaacatgaatagatgttgaattttttcaaaagccttttctgcatctattgagctaatcttgtggtttttgtctttagttctgttcatgtgatgaatcacatgtattgattttcatatgatgaaccaaccttgcatcctggcgataaagcctacttgatcgtggtggataagcttttctgatgtgctgctggattctacttgccagtattttgctgaggattttgcattcatgttcatcaaagatatgggcctgaagttttcttttttgttgtatctctggcaggttttggaatcatgatgttgctggtctcatacaatgagttagggaggagtttcttctcaaatttttggaattgtctcagcagaaatggctccagctcttcttggtacagctggtaaagttcagatttcaattcctctgatcctgggcttttttgggttggtagactacttattactgtctcaatttcagaacttgttattgatctgttcagagattcaatttcttcctggttcaatcttgaaagggtgttatttgtccaggaatttatccatttcttccagttttttttttttttttagtttataagtatagaggtgttcataatatcctctggtggttgtttgtatttccgtgaggtcagtggtaatatcccttttgtcatttctgattgtatttgaaccttctttttttttctttatttgtctagctagttatctatctatttcattaattttttttttcaaaaaacaagctcctggattcactgatgttttgaatagttttttgcatctctatctccttcagttcagctctgattttggttacttttttgtcttctgctagctttgggttttgtttgctcttgcttctctagttcttttagttgtgatgttaggttgtttgagatccttttacattttgatgtggacatttaatgctataaatttccctgttaacaccgccttagctgtgtcccagagattctggtatttttttttctttgttctgattgataaattacaaagaacttcttgatttctgccttaatttcattatttcccccaaagtcattcaggagtaggttgttcaatttccatgtaattgtgtggttttgagtgaatttcttagtcttgatttctaatttgattgtgctgtggtctgagagagtagttgttatgattttagttcttttgcatttgctaaggaatgttttgcttctgattatgtgattggtattagagtaagtgccatgtggtgatgagaagaatgaatgtgatatggtttggctgtgtccccatccaaatctcatcttgaattgtagttcccataatctccatgtgtcatgggagggacctagtaggaggtaattgaatcattggggtggttacccccatgctgctcttcttgtgatagtgagtaagttctcacgagatctcatggttttataaggggcttttcctccttttgctcaatgcttctccttgctgcaatgtgaagaaggacatgtttgcttccatttccatcatgattgtaagtttcctgaggcctcctcagccatgctgaactgtgagtcaattaaacctctttcctttttgaattacccagtttcaggtaattctttatagcagcatgaaaccagactaataaaaaatgttatgttgtttcttggtggggcgttccatagataaatatcaagtccatttgatacagggctgagtacagattctgaatatattttgttaattttctgcctcgatgatgtgtctagtattgtcagtggggtgttaaaatctctcactattattgtgtggaagtctaagtctctttgaaggtctctatgaatctgagtgcttctatgttgggtgcatatatatttaggatacttagatcttcatgttgaattgaaacctttaccattgtgtaatgcccttctttgtctttttttatctttattggttttatgtctgttttgttagaaactaggctagcaacttctgttttttttttctgtttttcctgtccttggaaagactggaattttcctccattttttattttgaacctatgtgtgtcttagcatgtgagatgggtctcttgaagacagcatggcaatggatcttggttctttatctagtttgtcattctgtgtcttttaattgggtcatttagcccatttacatttagtattattgttgtcatttgtggattagatcctgtcatcatgatgttagctggttattttgcagacttgtttatgtggttgcttcatagtgtcacttgtctgtgtacttcagtgtgcttttgtagtggctggtaatggtctttcctttcatatttagtgatttcttcaggagctcttgtaaggcagttctggtggtaacaaatttcttcagcatttgcttgcctgaaaaggatcttatttctcctttgattacgaaacttagtttggccagatataaaattctgggttggagattctttctttaagagcattgaattttagcgcccgattccttctggtttatagagcttcagcttagaggtccgctgttagtctgatgtacttccctttgtagatgacatggcctttctgtctggctgcctttaacattttttctttcattttgaccttggagaaccatgtggttatgtgtcttggtgatgatcttttcatagagtatcttactggggttctctgcattgcctgaatttgaatgctgtcccctctagctaggttgggggaaggtttcatggatgatattctgaaatatgttttctaagttggttccattctccccatctatttcaggtacaccagtcatatattcaatttcattacataatctcatatttctcagaggttttgttcattcattttcactattttttctttattcttgtgtgtctgtcttatttcagaaaggaagtcttgagctctgagattcattcttttgctttgtctattctgctattactacttgtggttgcactgtgaaattcttgtagtgtgtttttcagccctatccagtcaattacattcttctctatactggctattttgtctgttggcttctgcaatgtttctttttttattatttgaatgaatatttatttaaagtttccaaaatattaccaagacactgtgctaagctgaaggtggaatatgcaatataaaagcagacatagtccctgtcctcagggagcttaccatctcattggggaaacaatcagtagacaaataaagaaaaataaaattagtgtcttaatagatagcaaagtcaattctttaggaagaaatcatattcttctttaactttctttgtaatgagatatttatttagttatttatttaaattccaatagttttgaaggaacaggtggtgtttcagaaaggtagtgtttaagttctgagtttctttcctccactttgtcttttctgctattactacttgtgattgcattatgaaattcttgtagtgtgtttttcagctctatcaatcaggtcagttacatttttctctatcctgactattttgtctatcagctccagtaatattttatcatgatttttgtcttccttgcattgggttacaatgtactgctttaactcagtaaccttcattcctctccacattctgaattctacttctgtcatttcagccatctcagcctcagcatgttgtaaacacattctttaatccattatcccatgtaactgtaatatttgtttatggttgttagtgtttgttcatgagttttgcaatttgcattgcttaaattctttctatgcagtcaaaactaggtatctctttctgtattaaatttgacttaggtattaggcttaaaatccatttcccatccatttaaaaataaaaccattcatgaatatattctccttgtactttaatggtttaacatttaaattaaatttaataacttttcatcagattataaaaattgatatgtaatcattgtgaaaaattcaaacaacacagaaaattgtaataaagaaagtaaaaggagccaaaaatagtagcattaaaaatttttgatatgttgaaaatgtcttttcagatgtatccttagtcatatatacaccatgtctgaggatgcaggtgtgtgtgttgttctaaatgctctatgcacactgctattgacactccaaaatatgtcgtggtgcctttttatgtcaattaatacaaatatttttcattaccaccaacggttacatggtgcaccattttatggacttgttacaatacatttcattaaccatctgtttccagttttttattatttagacagttatttgataagatcatttgtttgcatatgtgtgtgcatgtatacctcacccaattgtcaggttaatccatttttatatatttctagactttgaatttttgacctaaaaagattgcaatttaaaatggttttacgtatatttctaaaagattgctataaatattgagaaatgtttacttctaacatctgcttaatctttacaaatttgatacttaaaaacttatacatctcattaaaaatatatctgaatgtcagagaagttagcacacatacacccaagtataacattttattaaatcctcaatttaattttccaagcataagaagtttttacctgaagtgaaatggcaacacaaggtaagaacagatgtagcatgttttgatgtattttttcttttggcgccatgcagttgcagttatactttctggacaaatttgcatcttgcttgatttgtgaagttccgcactttctttcccgctactcttttatactcagagctagtaattttattgtgaaagaacagagcaaagcagtgtatcctagaccatttcagggcatgtgtgcatggttttaaaactaaaattagtatcagaaaagctacattctcattcaggtggtggtaagggagggattgaataatttgaatgtgtcaatagaggatcctgatatcattaaacagtatctgcctctatctttccggtatttctagataaaaataaacaaagagagtattccatgaaaaaaaaacaacaaagatatgagaaaaatcatgaaacagtagagagaatattggtatctacgaaagttgtcatcccaacaaatatggttgtacacaaccaaatgctatggctctatgaacttcattgctgcagtggtataaaatataagccaagaagctttaagaaatgaggattagaaaagcttatgctctattttaaaagatttgactttattcaacatgtaacgggaaaccattagataattttaacccatgaagtaatacatgcatgtttgaatttcagaaaactccgatatttttgtggagactggattagagaagtactcacataaagaaaaagtagagagtgaagagtctgttgaaataacactggcaaaaattaatgtttgaatgaagaaaataaacttttaagaggcaaaattggtaggactttgtaaaagatgttataaataaagaagggaaaaagtgtcaaagattactggttcatatgctgaataggaaacatcggatttaatgcaagttttacttttatcaagaatatattataaaatggtaagttcaagagtattgaagatgtgtacaaacggtgattattatcattcaaagtcaaatttaagatagacaaggaggaaagaaaacatatcaaatacatgatagtcaaaagataaaaatatttatggtcctggtgggagcaaaggatgttggaattgtagttctagaggaactgagccagaaagataggaaatggcgatcagagggtgggttacttgccattgagattacctagcatttgcagttattggtagttattttcagatatgagtgggagtgagtggctgaagtgggatggaaggcataatcattggaagagagaaagttcaggaactgagaacccctggtgttgagataattttccatatgaatgttaaaatcgctgaggatcaagacaggaatagggactacagagcgcagagttgcacagaacatagttctgaattagcgaaaattctaatggtattaaaaactttaagaggtaatcatggtattgtttcttagagattcccagtgtgatcatacaacctatatcatcacttttaaaaatattcccagtccatagcctataataagggcaagtttacacatgcaccatataatgatatcaatccctcatcacaaacgaatggaatacagatggacacctgaccattatattctcatcagaccactcaaatactcttcactagaaactttaattggggtccagtgactgggtcagtcattagtaggaaatttagttcaagagtcatgtagagtcatgggctgaggctccaattctggggtatctctgattagtcatgtgtgtttgctgagagttaaggagaaaaggcttttctgagagagaagcaggagaatggagcagcaaacagacataaacacacacatacacacacacagaaaaattgtcttgattctaaattctcatgaggtcatgttacatttcctatcactaaattctgtaaattctcatgtatccttaccatacttctaatatttagctatgctattttgatgggattcctcctccatgcaatcagatttgctttatgagagcagctataatttactcattcattcaataagcattaaatgagcacttactaagggcctggactgttggaagcactatggaagataaaaacacgagcaaaatatggtttctgtcagtcagaaaattaatagtggagaaaacaaatataaaatataattaaaacacaatgtaatgagtgctaaactagagatgagcggtaaatattatgatctcattaggcaaaaatacaatatgttagctaatctgaaagatctggtagagtcagaaaaagccggtagagtcaggtcaaatgagacaaaatttaaaagtgtcttgagcaataagcacatatttgcaaagtgaagatgtttgaatgtctagatggagaagtgaaggtaacttagaacaagagctttgaataattccaagattcaagggtgtgttagtctgttttgccttggccataaagactattactggagactgggcaatttataaagagaaaagttttttttggctcaagattctgcaggctgtaggagcgtgacaccagcatctacttctggtgaagcctcaggaaacttataaccgtgaagaaaggcaaagggagagtaggcatgtcacatgatgaaaaaagagcaagagagagatgggggaggtctcagactctttttaacaagtatatctcacattcactcattacttcaggagggcgccaagccatttgccagggatcttcccccatggcatgacccaaattcctcccattagtccccacctcagacatttcaagatgggatttggaggggacaaacgtccaaactatattagagggttaggtagattggataagttagcaaaggaaatgtgaaagaaaaggcaaagggaagaaactaggggactgtgatgtcatacaaactcagggcaaagagtatttcaaggaggtagatgtcaattacattggacattactgtgacattaagaaatacaatttttgaaggtttacattacattggtgatactggtttccttagctggaggaagtaaacttagttggagaagtttcagtacagcagtgagagcaaaatctggttgaaacaccttagtagtatgtgggaagtaagggattggagagagttaatatggacaattaattttttaaaatggctttgaaggtcaacagagcagtagccgaagagagaagtaaaatcacaggataatttttttaaagatgtaaatatttgagtgcattaaaatggagctaaagattctatcatatgtcagtgggtagagaaagaataattaaatgatcttgtgacaattagtaaaaggttatagaaatagtaatgaaatgatgttgtgacaattagcaaaaggttatgcacagagatgttaagcttggctttatttacaacagcccagaaagaaatgagccttaatgtcacaaaatgtcccaaaataaatgacgaaaatcttgaagatttttcataggatttgggtaggttattatgaagaatttaaaaataatatttcacagtaacattaatgagaaaaattatagtggccaaaaattaatcaagtgaaaaataaaaagtacagtgtaatatataaagcatattaactatgattcttattttgccattcacatacgcacaaacactggacaaagactggaataaaagaaaagaaattgttaagcagctatctgggtagtaagattactggtgattttactttaaaaaaactcaacttttaactttcaataataagcatgtattatttttataatcagaaagaaacaagtattgttctatactagatgagttaagcatgttacatatttctctagtagacaaaaatcctatgcttctaagaatgagacttattttcccatcaatttattatatcattatcatcaccaccatctctcttcttaaaatttatctcctacctcacccagactgcataatccaaatatttaaaaactctgaacatgaactactaggcttttcaaaatgtatgtgtagtgtgtgcgtgcacgttcacatttaaatgatggcaaaaatgtgtttcagggtctttttttaactcaaacaatttcacacctactttaatttttcaatcctgcattcagaagctaatatatttagaataaattctaatgaagccatggaaactatttaatgttatgtcaattattggtgattgtgtgggcaacaatgcagcctgtgtggctgattggaaattatttctcttttataaaaaagaaatcttgaagggttccaacttgctacgattaacgatacaagtaagcttaatttataactccaataagagcaaagaaagatattttttcaatgtggactggaaaaactgtgaaaatcatgataccaagatgttaccttcccattgtattcttaaagatttcagtttcttatttttgaaataatttgaggtgaaaatacccagtattaacattgaaagtagtaagcttttctgaagtgtcttattgtttgcaagtctttaactgaacttagagcctcaatgtgaacactatcagggtcacgtgttgtccctagcaccatctggtcacacagagaagtcctttagaactactgtagccttgggattggaaacacatgctgtgttctacctgaaagtgttagctttcattgtgaattacccatacatatctctgaaatccaagatggttatttatggtgggtgactctgaaatgaaccagatcagcaatctaatatgacagcgtatctcccaatgaagatgatgacagcccaggattttctggatttatttagtatagaaatgagacagagagagagagaaagagagagaactcaggatggtctttcacaaaatagattaagaacaaactatttacttgattgtgctgtttgagtcaatcattgaatagaaagatcagaaaatttaaatttaaaaatcagcacattcataacacataaaccaaatgagttagggaaactgaaaagcccacctacttaacttctccctaatattctttaagagcatgaacattttcgcatttcaaagaaaaacaaagaaacgaaactagcaaaagacaatataaaattagtacttgaaaccattacaacagaataacaagtctaataaagatggcacaacaagtgtccagtttaactaaccacttgtgtcccaagcatatggaaatgactgataaactatcagaaggaaagacaaacaaaaacatagcaaattcaaaagcaatataatttctctctgaaccaaaaggacaacagagaaacacagtgttaaagtgggctgaaggtgcagctgcgctaggctgtttgtaagcggacaaatggaacaaggacttgtgctcctgtgtagtattaggaacttagcatcctctataaagacaggttaccaaagcaaagttctttgctagaaatcagaccctgaattatcacttcccatcttctttagctgggaaaatgtttgggaccatgaaattttaaagaactcaggaactaggaaattgaaaatataaagataggatctatgaccagaaatctttgttatccatttgatggccctgtgattttctcttgtttatgattaataaatggcatcgtaagaaaaactagagtctgcatggcacttaaggggtttggtggataaaattatacaaacaagcaacgggagtttattcaagataaattttctgtttgtgtgtgtgtgtgtgtgtgtgtgacagaaagagagagaggaagaaaatgagaaagaaaaaattctccctttaaagataagcctgtacatgagaattctaaaacataatgagaaatttcatgctaagaacttaggcaaacaaaataatcagtattacgaatatatatttattacaaattaaatcaatttaaagaaacaatatgtaaagactatgaaactgatacgtttaaacaaaggaaaattacaaatcaatatccacaatgtcattttctgccatttatctacaaagaccaataatactattttgaagaacaaagtatggggacttgtcctattatatatcaacatttatccaaaaatggcaattaagacagagtggtcttgttgaaatgattacaaacggacaagtagaacagacatcctagaaactggtatatttatgtgtgaaaactgaaaatatgaaatagatggcaattcaaatatgagggggaaagtataaatgataccggaaaattggttattcgtgtaaaaaaataaaattagattgtgcatcacagcagatcaaaactaaatccaggtggataaaagaactggatgtgaaaatcaaaattgcaacacttttagaatactatatagaaaactggctcaatgactacaagatgggaaagtatgcattacaaatgatgaaacaatgacagtatgaagaaaataattctatcactggcttaggttgtaataaaaaatatttggtaacattaccataaacgaagtggaatgaaaagtggaatcttggggaaattttatttgaaaaaatgaatagcttaaaaaagattaatatatagaattggtaaatagctacgaataaaaataatggttagtttatggatagtatacccataaaatgggaaactctgcagctgttaaataataaagcagatctatattttttgataaggaaatatatctatgaaatgttattaatgaaatcaagcaagatttagaacagtgtgtatagtatgctacctttgaatatgtgtatttgaaaagcacatacattttctgtactcagtaggttacaagatgcaacaggaacgaaactattcttaggaaaggaatttggctaaaaaataaaaggtaagacaataccaggggctagaaatggggtacttcatacactgccaatgtaaacttaaattgacataaacagggagcaatttcatagtttctaattaagttgaatatgtgcatgttgtttgatccattagtttcactctaaggcatacacctggaacagtggttctcagagtgagctggggacccttggggaggtccttgagatgcttgtagatggtcaggaaaggacaagttagatttatattattactaagatattatttgcctttttcaccatattgacttgtgtactaatggagtaaaatcaatgactaaaactgatagcacattaacatgaatcaagatggagtaacaaaacatactagtaaacatcttatttttcatgatcacatattcacagtggaaaataaaagacaagaagaaaaaagcaagttttatttaacaatatctttaacgaaacaaaaaaattagtaactgcactaaatcttaaaccttgagaatgtatctttaaaaaatattattggtgacaaaatgggaggtacacacaaagtacttctactttataccaaagtagataatgtcttaaggaaatgcacttctgtgattgagttccaaattgaactagctgcttttattcatggactgccattttaattgaaaagataaatgacaaaccattgttttctacttactagtttttccttctatttttagttgacatataatacttggatatatttttgggatactgagtggcactttgatacatgtatacaatgtgtaatgatcaaatcagggtaattaacattttcatcacttcaaacatttgtaatttctttgtggtgggacatttaaaatcctcttttctagctttttgaaaatacacaataaattactgttaaccatattgacactacagtgctatagagcactagaaattattcctcctatctagctgcaattttgtatcccttaaccaacctctcttttattcctcctcctcattaccctcccagtccctaataactactattttattatctatttttatgagctcagagctgtttttcaactccgacatgtgagtgaaaacatgtgctatttgtctttctgtgtctgtctcatttcatttagcacaatgtcctccaggcttaacccatgtggttgcaaataacaggatttcattcatttttatgcccaaatagtatttcattatgtatacatactggattttctttatgcattaacctgctgatggatattgcatatcttggctattgtaaatagtgcttcaatacacatgggggtgtgggtatccctttgatatatggattttttaaaaatgtatacccaatagtggaattgctggatcatgtggtagttttatttttagttttttgagaaacgtccatactgttttcaataatgacttaataatttacattcccaccaacagtatacgagggttatcttttttccacatattcaccagcctttgtggtttttttgtctttttgatgatagtaattttaactgggacgagatgatatctcattgtggtattaatttacgttcactaatgattagtgctgctgtacattttttcatatacctttggccacttgtatttttttgaaaaatatctattcagactctttgcctattttgtaatgagaattttgttttattttgttccataatgttgtgttttgttttttgtttgtttgtttgttttgcttttgagttgagttccttgtatactctggatatcagttccttgctggatatatagtttgtaaatatagtccctcattcttcagattgtctctttactctgttgattgtttcttttgctgtgcagaagctttttagcttaatgtagcctcatttgtctatttttgtttgtgttgcccaagcttttgaagtctttcctatagcatctttgcctacaataatgtcgtggagctttccctctatgttttcttctagtagttttacagtttcaggtcttacattaaagtattttatgtattttgagttgatttgtgttcattcttctgcatatgagtatccagttttcccatcatcgttggttgagtaagttgttctttttctaatatataatcttgaagcctcctccaaaagttagttggcttcaaatacatggatttatttctgggttctctgttttattcaattggtctatgttttctgtttcaatacgaatttcatggtgttttgtctactatagctttgtcaaactattgttatttagacaagcttttggcagacattttctgagaaatgaagggagtgtaccacttcaaggaaaacaaatgagagtgtttgttgccaatgatcttacttgaaaattcaagcaaaaatgggaatttttcaaaaatttttatctaccatgcaatcttgaccgtttcctaatacttaaagacttttctgatgagtttggcaatgaaatccataaatataactttttatattgtataaatgaaaagatctgcgtttggaaggtctacatactttagggaaccaccgttttctaaatcaccaattcaagatgttacaaattagtcatcagtaaaaatccaaagcacaagaaaaacaaatggagtttaacgtaaataagtatacaacttttcattgatttggtttcagattctacattgcaaataacctttaagaaactaccacctattgagttttggtgtaatatcaaagaatatccataattacccaaaaaggttattaagacactgctgtcttttcttacctcatttctgcctggggctggattttactgatatactgcaaagaagatgtttcactccagattggattaggaaaattcagatggcatttttttttttttttttggtcagaaatcaaagatattttccaaaatataaaatgatgtcacatttctcactacatgtcttattttataattataattatttttcctaagtgtcatttattttaatatgtaattggtttattattatatttaaattagttaaaacataaatatattaacactttttagttttaattcttaaaactaaatactgatacatataacccacataaacaaaagaaaggctctttgaggtccacaataatttttaagagtgtaaactggtcctgagaccaaaacattttagaactgctgctctagagaaaatattttcaattgttgtaaaatatacgtaacacaaaatttaccatcttatttcaagtttatagttcggtagtgttcagtatattcacattgttgtataacctacataaattcataaacaggaacacaaaaaaatgaaaaagatattcaatgaagcatcatttataacatcgtttataattgtatttagattgtttatgtgggaagcaatgtatctatcaagagaaaaaagttaattttatattaatatctataaattctattgtgtgtttatacaatgcaattatatttttccattgaaatgaacaaattaaatctacatatatcaacatcgagaaatttcaaaattataatgccatgcaagaaagcaagctactgaataaagtgtataggtgaatataatttatcaaaatatgtaatgtatgtaaagcttgaaaatatgcaaacagtgttgaatattgattattgacacatacacaggaagtagtaatatatagatgtgtgtaggaatgatttatacttattcagaaaaatgattacttctggaagggcatggagggagatgaattcaggcagggccacactggggctttaactgtatctataatatcttttccaaaaaagaaaagtagaaaataactgaatataattaaccaatgttaattaaccaaaattaaccactctgtcacccaggctggagtgcagtggtgcaatcatggctcactgcagcctcaacctctcgagttcaaccaatcctcccacctcagcctactgagcacctgagaccactggcacccgccagcacggcggttttttaatttttatttttttgtagagacaggatctctcaatgttgcccaggctggtctggaactcctggcctcaagaaatcctcctgccttggcctcctaaagtgctagaattataggcatgaaccactgtgcccagctagaattttccaaagatggaaagctgggtagtagtaaaaatatgttctccatgtatccaaaatactattctatatatccccagtgagagagattgacagcaaataaaagtatcctcctttccttcattcagttgacaaatattccttgagcacaggggatacaattgtgagctaaaatgcatttcctgatctcaaggggctgacattccaacagaacaacctatatagacccaggcattgttcttatgttaatgtatttaaagatgatctttattttgagaggaatgggaagtagttttaaatggttttgaatttcatcagactcttttgatcactgggctgaattgtcgccctgggactgagtccctaccttttccttatcacacaattaaataaaaaggtagagacattaattcatcagatatttattgagtgcttgctatgttccgcacgctgttctatgtaaatatagatacagcagtgaacaagacaaagttcctctcttaatggagcttgtaatcaagtttgacatcatataaaattcaactatgcatttatttattcaataaatatttattgaataatcattatgtgccagatactgttttagaaactgagaatctaagagtgaacaagacagactaagttttttttttcttttctttaggatatttccctcaaggggagacatacaataaaaagacaccaaaaaatagatacttggtaaacaagtatacaaggtaacatatagtcgtaagtattatgaagataacagaacagggtgatggttgtgagattgatgggtaagagttgagaaaccctttctaatgagatattttcacagcaataggaaatgcatgagcaaatgagccgtggatttctggcagagaagaggaaatgcaaatgcttctaggaggagcatgcttagtgcatttgaggagcagcatggaagccagtgtgactgtcactgagtaaccaagcagagcgcttggagctcagatcagtgtggtaggaaagagctagatcatggaggagactgtctcaaagaagaatatctctgtaaatgtctgtgacacagttgtatgctataaatattgcaatgaactttcttcatttagccattcaaaggcccttgcccctgaccttttggtcacattgagtggttaatggggttataatcccagaaagtgaaagtagaatggggtaaaaaattcctctttggttgggctttcactcttagacactgttacagtaaatgagagagagccaggacacaagaggtgcactcagctccataggccaggtcaccacacaacctggaagagagttcaaccctgatatttgtttataatcacctagttgcacaaaatgtaaacctgtccatgaccattagctcctccctgtgcctcaaataatggggttaaaagaatggactcagaactagagtgtctatactattagtgagaggaggggccagctggacttcctgggtcaagtaggggctcagaaagctgtgaaactcactcatttcctgcatcagggcttccttcggtcctggatggataatattgaagatatatgcttaaaatattcctaacaccaggatttgtgcatgtgttttcttccccaagaaagctataaacactgaaaattttgctctaagtttccctgtgtcctttctccctctctcccttccccctcctccgagactaaagtaaaaggaatattaactgcccgtttttctgtgaccagcagaccttatctatgctcccaattccaattccttgtaaacatactttgtaaagtcctgtgagatcttgtcttttttgccatgccactgaaaggtcataaaatagatgaaacctaagttgcaattccggttttcctcaagatctaaaacatgtcacaagtggttaattgtctgtgtttctcgctctggtaacatcttcccactgcacgtatttcctgccttaaagagtttaaaaggcaatcgtataatctaactctggctacccgttcgggaccccttccacactgtggaagctttgttgtgtcactctgctcaataaagcctacagctttttctctctctcggtccttgtctccatcactcgccgcggtccgccaccacaccaattctttggcgtggctaggcaagaaccttaagcgttacattaggttggtgcaaaagtaattgtggttttttcctgttaaaggtaatggattaataggattctgaattcatctttctgagctgtgtggcattagacaaatggcttcatttctctacagctcattctccttactgataaaatggggctaataatcaaatgtttgccatagggctgctgtgagagttaaatgtaataattcatgtaaaatcttagactcatacatgccccatagtgttttaaaatactggccatcatcatcgttattgatattattatattttaatgacaattattgtgtgctttttttttttttgtggagatggagtttttctcttgttgcccaggctagagtgcaatggcacaatctcggctcaccgcaaactccgcctcctgggttcaaattattcgcctgcgtcagcctccccggtagctgggatttcaggcgtgtgccaccacaccctgctaattttgtatttttagtagagacggggtttctccatgttggtcaggctggtctcgaactcccgacctcaggtgatccacccgccttagcctcccaaagtgctgggattacatgtgtgagccaccgcacccggtggcaattattgttaacccaatatccattagattaattcatctttcatgtgatgtatgaatttcctaaatctgcttgttgggtatctgccctcaactttattcaattcctgacattccagctaatgtggtctttttaaagctttatgataatgtacatgctcttgcttaaaagccatgttttcacagggagtggtggcttatgcctgtaatcccagaactttgagaggccaaggtgggcagattgcctgagtccaggagttcaagaccagcctggaaaatatggcgaaacctcttctctactaaaaacacaaaacattagctggatgtggtggcatgtgcctgtaatctcagctactcaggaggctgaggtgggagaatcacctgagcccagtaggtctagactgtagtaagcagagactgcaccactgcacttttagcctgggcaaccagagtgagactgtctgaaaaaaaaaaagaaaataaaaaaagcaatgtctccactgcccttatgatataaagatcaacttcttaacatgactttcaatgtgtgtcatgatctgttcgtggttttctaatttcacttctcatcactattttccttggatggttagtgtcagcctctcttaactgtgttcaatattctaggtgcatgatgctcatctgtcttggcctagagaagttgttcttaaactatgatctatggaccagccacatcactatcagcaccaccaaggaactcataagaaatgcaaattattaggctccacccccaacctattgaatcagaaattatgggggcgggttctggtatatgttctttacgaaaaccagcagatgattctgttgcacaatcaagtttgagaactgctggcctagatatctttttccaaggtcctcaagattttgcttgaagaacgtacaagaaattttcaagatttatcgtagatcttacctcttactctctaagaaagctccttgcattcaccttccattttatttgttcatctttccctttagactatgatggtttggaaagcatagaagtgtcttcataaaatttgcatacccaaaatatagcatagtaccttaatgtatcatatgtggttcaataaattatgtagcaataagtgaaagaataaataaataaatgaacagatagtatgagaaaatattatcttaacagtgggcactattagggagagaaccatgtttaggaaaatgttttcacatgccacttatgggtcaaaagtgacatcctgaaggcatgaattacaagggaatggaaaaaacagttaaattgctctgcataagaggtgaacaagaatatctgaagttggataaataaaggatgagataaccaaaagagagaggttagcaaatatgacagaaagatgaagaattttagagaaaagttttgagtgagaaaagtccagtgaggctttgaagaatagatacatagaatgttcatgtctgggtttgtgatattgcaataagagatgtcctctgttggtcatcaagtatacattaaagtataatgaggctgtattcaacatagcttgtgtggccatgttgcggagattactgtggcacaccatacaagaaactatgtgctgccctacagtaacctctctgtgatgtctctagagataacctaattgtcaggaagaaggcagtggtccagaagtcccaggcagtggagccgaggaaggtgcaagaagctgcttccacctgaaaataattcaatcatagatatatcttttttcttgttattcttgtcattgttgctgctgcatctctcaaatatactagatgggggccatcttagtaggtggaggacaggtaatatcagtgttacatatttgataactttaaattatattcacaaattctctgataggcttcctttcaagaagtgaagctgaactcattttcagtatgagctagacttagtgacttgcttccagcaatgagaatatggtggaagtgatgagatgtcacttccagtgggtacagaaggactgtgacttccttcttgctgttctccagcaccccctcacaatcaactctcttcctttgccctctatccagtatccagtgaggaactgaggccacataagtgggcttggaaatgagtcccttaaccccagtgatgccttcagatgattgaagcactgaccagcagcttgacttgcaagatcatgagagactctgagctgtaaccactcagctaagtagcttttggatttctgacccatagaaacagtgatgtagcaagcatttgttttttaagcttcaaagatgtaaataatgtgttacacagcaatagataacggatacccatatggttatcctatcttatgaggaataaactgaaatctcaagaggtcaatgggtttgtcccatgaacaaaaagctataaattcttagagctgccattcaaaccctagccttgtaactcctaattcattagtcctaccattatatcagactgccatcagtcatgtgtaacttatttattatattcccaaacctagaatataattctaagggcattattaaatcttaatcagaaatatcaaaatatgaaggtccatggtttaatcattgtctttgtatatcctaaccaagaacatgcgtaccaactccaaaactgcaaaaactaattattagaacaagaaagtagcaagggactttcgagatatctgtaataaagtttcactatgtagacagagagaacccctgagagaggaaattactggaaaatgccacagcttgagtaagagatggaacaaagactcacctcaactgtacaaagaaaacgtttttgaaatttagttttaatgtagttagttccttgaggacagagacttacaagttgatgtgctcaaagcttggcacaatggctggaacagaatgtcaagacactcttttgagacagagtctcgccctgtaccctggctggagtgcaatggtgcgatcttggctcactgaaacctccgcctccaagcgagtctcctgcttcagcctcccaagtagctgggattacagatgtgtgccaccacacctggctaacttttgtatctttagtagagatggggtttcaccatgttggccaggctggtctcaaactcctgactttgtgatccgcccgcctcagcctcccaaagttctgggattacaggcacgagccaccgcaccaggcccaaaacactcttatctagcctcttgctagattaataatgcactctattacttctgtaaaatatagtgatgaatgctctaaggcatactgaaaactcacagctaattgcctacccacttgtatacatctgcttccacctgttgagttgtatgctcaccaacagcctttatgttcatttccaaatcactttatgccaaatgtacaaattattataataacttgatttgattgaaaattatagaaactaattaaatataagtttaaaatgagaagtattctttttatgaaacctcaaactattggaaaagatttgataaaggaaatttgttaattaaaaaatttttactatttttaattttttttatacaattagatatgggagagagtttagaaaaaataaaacaaaaatctagaagcattctgcttaaggggtgtcctcaagtttctgctacatttcatagaaggtgaaacttaatattagagatgatgccttatcatgtggtttacaatgataagcttagtcaaaggacccacacacatttaaaaggccatgagaaagaaaaatgaggccaacacagagaaacataaatgtttgtttatattatgtaaaatacatacgttatctaagataagtatatgtaatttgtaaatgattttcagcttcagccaatgttttcaattaatcaactaagtattggtcacaattagataataaggcttctgctgtaatgtatatgaagtgtgtaataaatgaattaatgccaactctgatgaagtagataaaacaaggcaccctacagatgtaaggcatttttcagtttatttggaaacttgtcaatactcatctaatttacaccgaaatttcaaccttgtttttcatcgttgtgtaattagaagacatctgaacaaaaataaagaacttccaagtctttgtttgtttcatgttgcacttatctccctccttggcagggtaggtttctttctttgggtgttttgtgaaatttatcccttggcagctctagttgattggcttacatactgggtgagagtttgtaagcagagtagtgtttccagtgccatctacaatgtgatggtggtttctgacaagagtttccagtgctgctaagcaaccattactgatggctaaaaatagggaacaactatcatatttatgggactctgaaagcttaaggagcttttacaagccaattgctttggtacataattactataagattcagcttttgaaacggattaaaatatattgtgtgtgaatctgcaataattttctacagccaaaactgttcctcagattaaaggctttgtttgcattgatttcttttctatttaaaaatattaatcgtacttcatctgggtagacattttcttcccgtgtccttatttccctgaattaaagagatgcaataatatataaacaatacaaatatggagggtagatttgaaacttccttctgaaggaactgttgatttcttcacacttgtgtctttatatattaccattttatcatgaatccgtttacctctgcattatttcatatttgcattcattaacattaattacttatagttaccattttttatctctttatcaaccatccctcttttcatctgtgcatttatttattgacctagctgccctgcaagcgtccatcttcatcaactctttatctatttgtctagtatcatataatgtcttctctttattttgaagttgtacttaaaaccattgcaaaacttgcatcactatccctttctgactccttacatataaaaaaatgacttgtagcacctaacacgccccacaaataacacatctaatttcaagctccatgagggcagaggacatatatctctttgtgctcacattgtgtctccaatcctagtacagtgagtgactggcctttaatagttgcccaatacatattcattaaatgaatgcataaatatctcccatgtgtttatatccttatccatttctcactctttttgaccatcgctccatcagtttctttctcatcatcatccttttattacctactttcacttctacaagcctgtctgtcaggtttttcactcatcatcccaactattcatctatccatttctatacctaaagctccctatctgtatctaagcagctatctaacattttgttaatatattacaagatatttttatttgttcataattgcatctatgcctctttcatctccttgtcattcattaatccatcattctccaccatgcttttaacctaagttatattgcgtatcgttttaatatcgaatgataaggtctgcacagtttccagtgaaaggtccaaaggaaggatgacagagagtttgcacctttctccatttattttatacgaattcaattatacaaattcagcaaataaaaataaaaaagaagagaaaaaaacagcaacttaagtagtgcctgtcacttcatttaatgaatgtagccaataaatgaaacatgatatatcgattcctaaagtcctcctaatgagattacaaagtttaagaacacgtattcatacaaaacgcccttgcaacacaagccgactatttttttgtgtagctcacccagaaaaacagcaatttgttccaaatttttagttaaaaatagctatgtcggttctgctaaccaacagtagtatgcttaagaccacactcctatctctacacattcaaagtcacagccacctaactgcatatagtagaatatttttagccatttcaaatattttagctatttcaaatggctttttcttttttataagccacaattgattttaccatctcaaatttttctgagctaacaatcattttaatcattttatctagtctctcagtttctttcataatgcagaatcttccattctggatcccctgtcctcacactgtcagctggactgttctgtaggactcttaaatggctgcaatgctgaaatttcccttattgctttattggattctatgtcttcatcttcctggctttgcatttttcctagaggatattctcaaaaaacatcttgaaatacatgaaatgagcgaaatgaacatgttcaagaccttcctgcttgaaacttttttttttttttttttttttttttgtttgagacggagtctcgctctgtcgtctgtcgcccaggctggagtgcagtggcgcgatctcggctcactgcaagctccgcctcctgggttcacgccattctcctgcctcagcctcccgagtagctgggactacaggcgccccgccacaatgcccggctaattttctgtatttttagtagagacagggtttcaccatgttagccaggatggtctcgatctcctgacctcgtgatccacccccccacagcctcccaaagtgctgggattacaggcatgagccaccgcgcccggccgaaaagttctttattttcacctttacatttgatagtttagggagcaaaaactttctcacatccgtgcattttcttctcaaagtttgaagcatttcttcattggtttctcgcattcagcataattgatgaaaagtttgatgtcagaactacacattcttttgtacgtaactgactgcttatcaacaactccagtcctagctcccaggaacactttgtttttgtattttctttgctgttataaaattttacaattatatagaaaagaaaggttatcaattttcatttattgttctgggtattttgatatgaaaagttgtgtcctctttgggaaagtctcttctattatttactgaatatgttttactcatagattctgtattctccctttatagaatgcccaataatcatatattaaaactacgaaacaaagactaattttatatttttccacatttttaatcttttttatgagatttatttaaatttaatttcaagtttttatattaaaaattttgttggtgattttaaatttcaaagacatttttctttttccatagttgtgtgtttcttcctcctttttttttttggattcactctctggaaacttactatagtttttttattcttttaattttgtttctttcgtctggactgatttgctttttgttttttcttattttctttctgtacatgtttttcttagatgtgtggtgatatttctttgttcatattttagaatgaagcagcaaaaacctactagagactgttgtttacatggttggagatttcaaatgatgggttttagtttatcataaaaaagagtagaagcttgaatgtatgttctggaactactaaattgcagaacacccattaatttgctatgagccgaaaatatccaaacaataacctctgttttctttaactaattttatttctctagtgaataattttaattttttttcaagcagttaaatacattactactaggattgttccacttctggtgttacaaggtgagaatcttcttagacctgtgacccagtgaaattgttgaaaattatacatatattttatatatatgttgtatttattatatatgtacgtgtgtgtgcacgcacgtgcgtgtgtgtctacatttaagtctcaggaaatggtactaaatgtatatagcaaattaagaaacctttattccaaaaatctattaaaattcttcaagaacagtgagagtctgtggttattgaaccaagaaccattctctttttcctctgtcagagctcagtgagccagaaactccattccagactgatgcagccaaaaatggaggaattcttctgcctccagcttttagtcacgggactaccctcccaggaagcatgggcaggatgttgacattcctcatccagtccccagctacctgttgctaaattctgggtgagtgaaactaagaaataggagcttcctttttcttcccagctcacgcttgtgagactaaggctctaccttgggtgaaacactgccaagaatattgcgtcactgattagccttttcctctcttgcaggatggcaacttcatgctgggagaggcaagcagaagatctgagtcttctcctggaactgagcacccagtcttaaactgggagtgtcgctcagggataagtgtgacgttgtccccattttcaactccaaagccatggctcaaggatttttcttgggaagaggaggctataaacagagtgctccaaatatcgtcccaaagaaattgatttaatttgcaacagagtgtggaaaagttcaaatctaaaagtgttactgtggactgaatttagtcccacccaaatttacaagatgaagctctaacccccaacgtgatggcacttggagatggagcctttgagagatacttaggtttagacaaggtcactgggggggggctctcattatgagatttataagaagagacacaggagcttatctgctttctctctctctctctctttctgccagccacatgaagacacagcaaaaaagcaatcatctccaagccagaaagagaacctttccagaaacgtatcatgctggcctcttgacattatatataacagaaatgtattgcacagttttggtgactgggaagtccaagatagaggcacaggcagatttgttctctggtgaagacccacttcctggttcatagatggcagttctatgccgtaccttcgtataatggatgtggacaaaagaactcttgggacctcttttataaagtcattcatcccattcatgaagattccactctcatgacctaatcacatcccataggccccagctcttaataacatcacattggatattggattttaacatatgaattttgggggggagtcacaaccattgtctatagcaccaacttcagataattgttaaaaatcacttcttcattgtggttttcttccccttgtgtttattgttgtgcatttttgtcatttaggaggctataaaaacagcttgtttgctggagctttgcacatcattgcttcattcaaaagagaatctcagaaaattactgtgatgtctataatctaacaaagagaatcatggatgcactaagtatatactgtgaatttaactcagatgctcatgaacaaatggtttctttatacttgtatatcagctcctctatattaaagatgtagctaattaaacatatgtttattttttatgattattttagacatttttcttcttgagttttgcttgttctttgttgctaaccaaattgtttgaaaattcttaggaaaattacttatacctacaaattacgtatgatgtctaatttaaactctaaacagactctatttctcatgttacatagtggagaaggtataactccatatggttaattgttattttgaacctgaagtcttaacttggttaactatatcaccacagagtagatattcatcaatctcatgagcataaaccagtaattactattttaagtatgaacatattcttagtttcaggcatttttgtattaattagctaaccagttgttttggcttctgatacatctgttagtggggaattttttttaattcaatacttaaatggattaaagcctgcatgtgattgagagatgtggaaatattcctgcatatacaccacatatgtgcagaatttaaaggttaaacatttctatctcctattaaaatgttatgtaattaaatgctgaaatttaaaaagctgatttttgtttaaaatacacatgttctaaatttagaaattctaaaataaaatgttactacctcattagtatttttcaatttaaattaattttttggtgctttttagcttttaggttcagggatacatgtttaagtttgttacatatgtgactttcaaactctaacttcaggaagtcattacttccagtaggttatgttctggtcattcattcctctatcactattaccacccacagagctcatatgagctatgctggccctcaacatttctgatggaagagaataaatacatggttttgttgctctcttttacaaaatcaaatgttactttacactagaccaatgtttcctaagcctaactgtgtaccacaaagcacacttggagagatttttagtttgtttcgtttgtttgttaactgtaaatttccagattctatttcaaatctaatgaaaaggaatctctatatgtggaattcagggagatatatatatatatattttttttaagcatgtcttctagtgtttctaatgccaccttgaaaccacagaatcatttgaggaaaccaatgtaattgacatttattacactcctccacatcagtatgaagggcatgagagcctaggttttgtagtgttcaccactgaattcccagtataaaacatagtatctgataggtcttagtcctttattaaacattagaatgagaaaataaatgagtttatgaatttaatgtctgtatcactataatgcaagtggaaggaacagggaaccagaaaagacctcagcctaagaacaaaggaagacaacttagtgacaattaccctgttatcaatagaagaataatgccttaaggatctgtcaggaccatttgtagttggaaatctgatttcaggaggctataatagcagcttgtgtcctggagcttttcacatcattgctttattcaagagagaatcatagaaacctactgtgatgtcagtaatctagcaaagagaatcatggctgcactaagtatatactgtgaatttaacttagatgttcatgaatgaatggtttctttatacttgtatattaaagatgtagctagttaaacatatgtttttatgtctaaacctaaacctatcatacacataatgtatgatgtctaatttaaaccctaaacagattctatttctcatgtaacacagtagatactactgtattctctgatgattcagtgattgttgtacaaaatgatttttaaactcacacatgttccctaaaccatatcaagcagggttgattgattgtataccaatcagcatcatctttttttttattgtgttcagaaatggcagcataggtattaaaagcttattaacatccttacaggttggctgcaaaacacgcgatcagtgtcagctgtggcctgtatagtcacaaaggttttctgttcttgttaaaaattgtactttctgaagcttttaagaaaattatattttgtagtttctttttgggggggctggggggcatacaaggaaacaaaacctcaattcatgagccttttaaacatagtcgtgtttgtctccctcacagatgtttttatgtttctattttttatatattcttttttaaccattcaatagaatcagatgattcagtcttcctcaccagcccattattattagtccatttttctacagatcttctctataagatatacagatgtaccgtatgaactcatttcttccctctctttctgcttttgaaattgatctctccattattctaagtgggttttgataatattctcttcatgcaataattccaaacatattcttgacatacctcctttgccctgaatacccataagcatcattactcaaaatagggaggatagagctgtgagtggtgacatggcctggataggctatatgtgcctttaatataaattcaataatttagaacaatagttttcagaaaaaagtgttgattttggttttgactacagtaatatgagcatgcaaacaaatttggctattgaatgatacaaattattaaatattttcctgctttatgatttagcagatttgtatgtgtgtgtgcttaactttgccttgtaatttgttagctagtaattaaataagagccagtttgtcaaaaacagaaatgatgaaattaaattgcattataaattaaagcatacattcccctcctttgtttcaagcttcaaaagcttgtgtaggctcaagtcctgtggccttaactacatatttggatctttacctgggtcttcaaagtccatatgccagtaattgaatgtaacctatttccatgctcccattcccaaattatctcctttcttctacccatctaagactatatatgttatcctcaagaaatagaagtgaagatcagacattggccctcactatattgtgagtgtgctgaggtagagcctccttattcaaggacagcctaaacagatacctcagagttaccaggcgtaactgaaatacaattgaaaaaatactatggtattctaggtttatactatttcttttacaacctgagttaataccatctcatatagaaacaaacattgaaaatgttctagagaaaactatcctactgataaaagtgcacacaattattactgagccctatagccatgccaaacaaagttaatttaaaaaaatggaagattaacttataaattccaagaggaaagcgcctgaaagccactgacgtagccggcggaggaccactgtgacgcacttgtgtactgcgtcagcactgtgtatccttggcgacgtcggcgctcgagctgcactcggccgggctcttggcagcaccctgtgctctgagggtgtcttgcccgccgggcgccgtggctcacgcctgtaatcccaacactttgggaggccgaggcgggcggatcacctgaggtcatgagttggagaccagcctggccaacatggcgaaagcccatctctactaaaaatacaaaaaattacccgggcgtggaggtgggcccctgtaatcccagctactcgggaggctgaggcacgagaatcgcttgaaactgagaggcgagggttgcagtgagctgagatcgcgccactgcactcaagcctgggcgagagtaagacttcctaaaaaaaaaaaaaaaaaagcgcattctcaaatcccgcagtcagtcctgcgggtggaacacttagaggaaaagtcagacctctctatatgcaggcccctccaatactgtattttctgtcggcttataagtggacccaggcagttcaaacccatgttattcaagggtcaactgtgtatataggaacagccattcgcctggcacagtggctcaagccggtagccccagcactttgggaggtcgaggcgggaggatcccaagagttccaggttacaatgaactgtgatagcgccactgcattccatcctgggcaccagagtgagacacttgtctcaaaaaaaaaaaaaaaaaaggaaaaggaatagccccccaaatctatatatatttcactagcagaataacagaacataccaaaatttaacagtaataatgtaaagattttcagccgtctgtattttccaaatcttcaaaaatgtctattttgggaatttggatattaaaatcttacttttaaaacaaaatttaacaaaacatttttaatagtgagagccttttagattttaaaagctcacatttgtgtaaacattacagtcttatgtggacaaatatcaaatgcgttgatatttttaactggaaatttgggctattttggttgtggataattttttatcctttttgtttttccatattttctaaattttgatataatgaacaagtattgcctttctaaaaaaggaaaaacagcattttgttttatttcaaccatattggatgtgaataaaagaaaagaaaaagatgattctgagcttaccagtgtgtgtgacccacattaacagaaatgacatgtaaagaaaatctagtttggagtggaaaatcctattttaggtagttgatttctttcacttgaggtaccatttatctatccatgtggggatagcctagtaggaagatgaaatggtaggacagagatcttgatggaagccagtagttgtggcacagttctgaggcccagctactccaaaggcagagggggaaacatccctttagcccaggagttggagactgcaatgagttatgttcatgcctttgcactccagcctctggaagagaatgagattcctatctctaaaatgaaaagagggccaggcacgatggctcacgcctgtaatcccagcacactgggaggcccagatgggtggattgcttgaggccaggagttcaagaccagcctggccaacatggtgaaaccctatctctactaaaaatgcaaaaattaactgggtatggtggtgcacgcctgtaatcccagcttctttggatggctgaggcaccagaattgcttgaacgtgggaggtggaggttgcagtgagctgggatcgtgccagtgcactccagcctgggtgacagagcagactctgtctcaaataataagaataataatatttaattaatttaaaaataaaaaccaaaagagaagatctgatggacttagaagtcatatatctcaggtgataggtgaaaccacaagtttgccttgaaaagtgtgttgatgacaatagccatacctaacaagtacttgctgtgttccaaagctctttttgttagcacttcatttgtattaactaatatcattcttccaccaactttgtaagggtactgttattatcctcagtttttacagataaggaaagcaaaagacagccaggtaccatggctcatgcctgtaatccaaaactttgggaggctgaggtgggaggatcacttgagcccagtagttcaagaccatcctgggcaacatagcaacaccctgtgcttacaaaaaaagagaaattaaaaactagccaggcatggtggtacatgccagtagtcccagctatttgggagactgaagcaggaggatctcttgaggctaggtgttggaggctgcagtgagctatgttcactccactgcactccagcttaggtgacagagaaagaccctgtctcaaaaaaaaaaaaaaaaaaaaaggaaaccaagagaatgagcactgaagcaacttgcccaaacacactcacctagtaaaaatggtatcattaattcatttatgctgaatatgttgaaaaggagtgcccaaagagagaaccttcttttctttctttctttcttttttttttttttttgagacggagtttcactctgtggtccaggctggactccagtggcgcaatctcggctcattgcaacctctgcctcccaggttcaagcaattcttgtgcctcagcctcccgagtagctgggattacaggtacgtgccatcacacctggctaattgttgtatttttagtagagacggggtttcaccatgttggacaggctggtcttgaactcctggcctccagtgaaccatcttagcctcccaaagtgctcggatacaggtgcccggcatccaccgcgcccagcatccaaagagagaatcttcttgaggaactcaaaagacttttctcttttggataagcagttcatatttctgcatttattagggattttcacattttacttcatttcacactactttttttttgttcagtggtataacattttcaccatggcactgaaaattccatttgcattaatgtccaatgtcatatattcctaccatgttgcaaatacagttcatttgtccagctttactgaggtataattcacaaataaaaattgtatacctttactaggtacaacatgatgttttgctatccaagcatacctcattttattgcactacattttattgtacttcacagatactatgtttttgacaaattgaaagtttatgcccactctgtgtcaaacaaatctttctgcatcatttttcttttttgagacagagtctcacactgccgcccaggctggagtacagtggcacgatctcagctcactgcaacctcctgtggcaggccaggtctcactaatgcagacttccataacaactgtttcagtaatgactgaatgaagttaaatactaaaagccagtgcccttatacaaaggctgggatgtaacaaaaggccatcaaaacttttgcctaggcctgtcctgggccttaaagcatgacaaaataatgaaggaattctttttatttatttatttttctttttgagatggagtcttgctttgtctgaatatgtcagcttgcttgataggtaacttgattgagtctaggtgttgcccatgcctactctgatctttaccctcaacctaaatagcatatgtatagttctcttgattaatccttaaactaactccctaccttacccccaccaaactagtatttctcctcaaggaaaatactgtctgctcacactggggccatggaagaaccacctgacatgagtttttgtgattttctgtttatctcaaaacttggccttcggcatttacatcttggatggctttttgtatctccattttctctttatagtttcataaacagttcctcttgaaaaattatcagtggtaaaatctgatgagtatcaatagtctccaaagtgctttttatcttcatcctttatccaatacattcttacaccctctgaaattgtttagtttgcagaaacttagcttacccctttttgactatttacagccatggcaatttttacttggtttgttttactgcccaagccagtcttagaatttctcaaagcctcaacccaaatataaaatccttcaggaatgagacttagtacaaatatatgggcaatattataaattttaattagcctaatggcctccatagtcctatgacaacctttgcaatttttgctgaactctatgcaaggtatctctacccaagagataactgagaattcctttcttacttacttttgttacaagtaattcctcttttgtttttaaaactacacgtggctctcctaatttttacctcctgaatcaacaacatatttacttatatttgcctcattagaacctaacttgcatatacacataataactccaggtatattggagttattatgtagctccaatgtaataattagacaatttaagagacttctcatgtcttccaggagatcatgcttacctggaagtgtctgagaggacactgatctccctggatgggggttacaaaagttgaaaaagctatcaaaacttggttaataatgctgactgaaaagataaagccataaagccctagaagtataaccaactaatctaaaataattaatccaagtggttacaggtaacagcatagctttagattgcttaatggtacaccaagaaaaaaatatgacatattgctaacagtccctgatgaatgtggagggaaggttgactaacctatagtcaaactgaaagaaaagacaatttggctaatcaaaagtggactcagaaggacctttgagatctgacctcctggtcagaataaggaaatctttggtcatcaatctaaagtgacttccagtgtctccttatcatcattctggttattcttgtctcacagtcttctaatgcctggtctccagagctgtatatgccactgcatagctgttatttcactgatggcacaaaaaattattttgcaatggaacgaaaaataaagggattctgatattcagtcaggccaaatgccaagcccttcagttagaattcctacaaaggtaataagccatacagcagtgaatacgtaatcatctgctctacttctacaggactaagggatggtgaaaataggggaggggattgttaaaactctgccaggttcccagtctgtgcactcaaaagtgttgaccctatgtccctgagcttaacattcatatcctgtctcagacctctttgttaagcaatgtctgtgcttttgtgacaaaagcagaaaaaataaaataaaataaaataaaataaaatggagaatttcgagtccccaaatgaaccaattagaacttaatgcctagaactggccaagcacagtggctcacgcctgtaatcgcagcacttcggaggccaaggtgggcagatcgcttcaggtcaggagttcgagaccaacctggtcaaaatggtgaacccgtatctctactaaaaatacaaaaattagccaggcatggtggcaggtgcctgtagtcccaactacttgggaggctgaggcaggagaatctcttgaacctgggaggcaaaggttgcagtgagctaagatggagccactgcagtccggcctgggcgacagaatgagactctgtctcaaaaaaaggaacttagtgcctagaatccttcccaacatgtaataagctttattttcttcttcatctatctctcccactttctgtgcggaaacactgaactcattacttaaccagcaagcagattgatttacatttatttatttaagctctggttgtgtttgtattattccttaaaggtatttataaaatattttattgaggcctggtgcggtggctcatgcctgtaatccccgcactttgggaggccaaggcaggcagatcatgaggtcaggagatctagagcatcctggctaacacagtgaaaccccgtctctactaaaaatacaaaaaaattagctgggcatggtggcatgcgcctgtagtcctagctacgtgggaggctgaggcaggacaacagtgtgaacccgggaggtggagcttgcagtgagccgagattgcgccactgcacctccagcctgggtgacagaacgagactccatctcaaaaaaaaaaaattttttttccaacaaatttgtttttgataagaaaatatctgataattattaattatctgcccccatccaatgcaagatggaagaagtagtactgaacattaatctagaaaattaagaatttttaaatatatccataagcttgtatgtttgacatcatgaagaaaaccacactattcctaaaatatattatactttatgtcataagcagagacagactattgcatgaataaaccaaacagaattagcttaccatagcttttttttgagacattttaaaagttattatttttatatttcatttactctcttgggtatctaagctagaattgatttactttcattacctttcaaattatcctcttgatttaggctttcagtgcagactggggaactagaaattccacagaaacaaatctcagaaaataaaattcccttagaatatgagtatcagaaaataatcttctaggtgtcatgacatcaaaagtttaaaaagttgatactttccacaatattttcatatagcagttctctagaaatgcttactggatgaatctacaatgaaccagagtgaaactgcctgttaccgagtaatatcccaatgggcatttggtctgtaaatacctaatatcccaatcaagtatctgctactagattaactgtaattgtaaggtactgcaactgggaggcataggggagtagattttttaaaagaaatgttccaaattatactttggcctaagtattcagccaaagtatgcttctccaattctgccttggcccatctcaagtcatttttggtatccctgaatgtcacatggtcagagattgcatgatcattcagttaccatcatatctaaacagggtaacaaaaatctggccaggcacagtgtcatgcctgtaagcccagcactttggaaggccaaagcgggcagatcgcttgagcccaggagctcaaaactagcctgggcaacatggcaaaaccccgtctctaccaaaaatgcaaaatttagccgggcgtggtggtgtgcgcccgtagtcccagctacttgggaggctgaggcaggacaatcgcccgaactcgggaggcggaggttgcagtgcgccgagattgcgccactgcactccagtctggacgacagagccaacctcgtttccaaaaaaaagtgagttgtgcactgggtcgccaagatgtcgttcccaaagtatactccttcacccctggccactatgccctcaaaccagccgaataggacatgtcttcggaaacccagcgggcgcaagccaagtgattgaccattaagagcctggctgaaacctgcttaccctaactgccgagggctcatcgaaaatcctgccttgattccttggacctatgcaagatcagcaagtgtctttcctaatttcagacccactcctaaaaactcactcttgggagctctgtgtggaattgggcccctcttcttctggtattatgttttcaaaactgacagggataggaaagaaaaacttatctgggaaggaaaattgggtccaacatttaacctgtcatattaagtctggcaatgatgactatgtattcttgcttaaataaatcgtctattaatcattaaacaaacaacaacaacagaaagtgagaattttttttttttttttgagacagagactcgctctgtctcccaggctggagtgcagtggtgcaatctgctcactgcagcctccgcctcctggattcaagcagttctcctgcctcagcctgccaagtagctgggattacaggcgcatgcgaccacacccagctaatttttgtatttttagtagagatggggtttcaccatgttagccaggctggtcttgaactactgacctcaggtgatccaccctcgaccttccacagtgctgagattacaggcgtgagccaccacacccggcccaagaatattttttcaagtatgtcatataggtgcagtggctcacgcctgtaattccagcactttgggagactgaggccagcagatcccttgagattgggagtttgagaccagcctggccaacatggtgagaccccgtctctaccaaaaaatacaaaaattagccgggcatggcgttgtgggcctgtagtcccagctactcaggaggctgaggcaggggaataatttgaacccgggaggcagaggttacagtgagccaagatcccaccgctgcactccagcctgggtgacagagttagatgccgtctcaaaaaaaaaaaaaaaatttactcttagtatctgaatattcattttccaattttaggtgttttacataaaacttggaatgaaaatctttttgtgtcactttgtatgttaaaattttctcaattagatgaagtataaatgtacattaatgcaagaagaaaatgtcacaatgattatgaatgctatttatgtacgaaagaaagtaacaattttcaaataggcaaataatagtgtaataatattgagagagttagctaatgaatttaagaatattaaatcctttttcagatgacaattataaaaactttaatgaaaaatacaaagcagaatagaaattttatatcataatttcaattgcattcagttgtcataccagtattaattatactaaacaaaatcatttctaaagactatgtttaatttttagttgttttataccatgaagtttttttcttccttttttttctgagactcaaaatccatgaatcttctatgagaaaatcttatttggggattcttcacatgtttttgtagataaattaaaagcagaatgttaactctaccacttcggaattttatgaggaggaaaacctccaaaagttcttacaacataatcatttttgctccagatattatatatgtgtatacatatttatatacatacacgtatatataaacacagacacatataaagacgttagaggaagaaagttcctccacctattttgtattccactaacttcagtggaaagtgaccctcaatttagtgtctgtatgtgcatgacagcaatcatagaaacaatctagcaacaggcagcactgagaaaattatcattactgcactataatgtcctactcttaaaataagattactaatatttctgagaataaattataataacttcagggataacatttcatatcttcacatatgccagaagtttactctatgatgatgataccgacttctgctccagctttaacaaatattggttttcacacttggccatttggcattcaaaaaagggatattttgtgcactaaatgtacagccaaaatatgtaggtaattcctatgtcaattcattatttcattccattttcatgtgcttatataaaatataattttaaaagaggatcttatatattccaaggatgtagaaaacaactcacagcctcccttatgggtctaacagaagatatcataaaaaactcaaccccacacagaagcaccagtgatctaataacattttattgttaactgccaataatcaagaaaaatccatgcaagaaaggtgttagttcttctgatctctatacattttcaatgaattcccttcacaggctgaaacttgtacacaatagaattgctttccatagctaaaaacttacagatctaagttagctagacttgacttcatagtctcttaaaatataaagattattaacatccttatacattaaaattttaatattttaagatttagacaagtgtcacgtaagatgaatttttaattaactaagatgaaattgtctgtgattcagtaatatccaaaataaaaacatttataaatgcccaaaatcccaatccagcaactgataccagagtaactatccttatgaagcaagggaaagatggctgaaactgaatgccacagataggctgtggttctcactcagctgcttagtcatcttagacaagttatttgcccttccaagtctgtttcctaaactataaaatgaatatattattatcttctctgtctaaatgttatagacatatatatataatatgaatattatatataaatatatatataatgaatatattattatcttctctgtctatatgtctaactaccaaatgaagttatggaaattacaaactctgatatatgtaaaatattgagtatcatgagggttccaaatctaggatctttattttcataccaactttatgaatagactgtgatcgatttttatgtagttttatgtttacttttaatgtttactctctttagaaactacttggaacttgattatttatttatttgccattcaagaatgtgagtatgatttatgaaaatgtattaacagttatctgaagtaataatgttaagctagaactcaaattacaaataaagaaaaacaaaacaaatataaaatcatttacaatagagaaagcttgctctttgccaagagtaataataatctgctgaaatcattattgttagtcacttaatgactactgtcttggttggtacacatcagcagcagtcaaataccacctcccagaacccaaccacccaaaaaaagatactgggaataagaatgtcctcagaaagctcaactgtaaaactaaaacataaaccagaacatagattaggaagtcaagcacggaggatcaagtaaaagataggactaaatttaagatactaacatgcaatgaaaagaaatatatctaccagaaatatggaggtgagtagtttggtcagcaatgaaagcagtgaaaaaggaaaggtacaaaacactatcacataagcattaaccaggagaaaggatatcctataaggcagattgatgtaagtaactgcttgacgagtatatcatggagctgagattatcactttatcagagtcgatgccatttaaaacttctagtcatttataatcaactcccttgttgttatctcatgatcttgttcagtaggcaactattgaaatttggttttccattcagcattctacagtgaaagaatacattccctgatgtaaatttctagtccttattttacttgaataaactggcgttctcttgtgatggggatgtatatgctcagataagaatgtgggctctggggatggaagctccggccgcggagtgatggtggcctcagcgaagatgggccgggcagggaccatggcagtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagcttcgagagctgtgcccaggagtgaacaaccagccctacctctgtgagagtggtcactgctgcagggagactggctgctgcacctactactatgagctctggtggttctggctgctctggactgtcctcatcctctttagctgctgttgggccttccgccaccgacgagctaaactcaggctgcaacaacagcagcggcagcgtgaaatcaacttgttggcctatcatggggcatgccatggggctggtcctttccctaccggttcactgcttgaccttcgcctcctcagcaccttcaagcccccagcctacgaggatgtggttcaccgcccaggcaccaccccccgccccccgcctccgcgccttatactgtcgccccaggccgccccttgactgcttccagtgaacaaacctgctgttcctcctcatccagctgccctgcccattttgaaggaacaaatgtggaaggtgtttcctcccaccagagtgccctccctcatcaggagggtgagcctggggcaggggtgacccctgcccccacacccccctcctgccgctatcgccgtttaactggcgactccggtattaagctctgcccttgtcctgcctccggtgagggtgagccagtcaaggaggtgagggttagtgccaccctgccagatctggaggactactccccgtgtgcactgcccccagattctgtaccgcaggtctttcccatggggctgtcttccagtgaaggggacatcccatacgtagttttgagagggtggatgggttacttgcccaccagaaacagccctagtcccaactccttgcgttccttttggcccctccctgcctacctagaatctgcctgaaagggctggagccctgaggagaggggcagtattgggggactgtgctagctttacccccgcaagacatacacaggagcctttgatctcattaaagagacgtgaaccagctaaaaaaaaaaaaaaaaaagagtgtgggctctggagtcaggttactttgagttcctactgacttactttgtgatcttgggaaatttaccaatctgttgtctgtttcctcatctgtagaaagggcgcctaataataggacctatttcccagggttgttgtgaggattaaacaattcatgtaaagcacttaaaacagtacgtgtcacatagcaagtgctaaacaaatgctagcctggttattatttttgaacatgaattaacattcctgtgtctgatcgctctgacactgatcagtttctaaatctaaaaaactgaagcagggtcactgtgtttcacaactccgggggcatcaatgcacaagagaacagagttctccggccgctctgaactgatggcatgacctggtgaattcaaggtcacccacctgtgaggttctttttgttagccaatctgtccaggtgaaaacttaagagtcataaacctaaaatgtctaccctagtgaggcagatctcctaaataagtgaggcacagcttgagtggtgagtttgccaagaaactatgaacgataagactgtggagcgtagagcacaagtcaagccttaaatgctttcaaatacagatattttaagatattctgtcaggcaaaaacaacagtataggcagattttaggcctgaagcccaccagtttgcaaaccctgcagcaccctttcattcaaaccttaaaatattttaacttaggataatgtacatcctgtgacctatttttaacctttatttttctttactgctctgtgactatcccttcttttctcctcccttggtttacaaaaacttctgtgctcttctccatacctcttgacacacataccttgagtggtatcattcatttcaactaacatttcaatcagctaaaaattccagatatttatatccaactctatcaatgctaagaaatacctcatgaatggtgcctgtctactttctcattgccaatgcctttggtcaagtcctcatctgatttctagacgtttacaatagctttggttcattctattctctcattgtccacatccagccaccactaaatcctactggttctaacaccaatcaaaccatatccacaatccaaccattttcacctaaaccatcatcatctgttacctaaattaccacagcagttccttttactattcatttacctcatttaccatactactcatttaccatataccatagaggatcctgtccctcctctgtttaatcccccattagctcccaggtcactcaagagtgaaatccaaggtccacacaatggcttacaaggccctatacaattgcctattacccctctaatttattctcttattattctctggccacatcccttgtgttttcctcaatcataccaggctcattcctggtccaggctttctctacctcccactccctttatatggatgctctttcctcaaatgtcttgggtctggattgttgtcttgtatcagggctctttgctcaaatgttactctttcataagtgcttccctaaacaccctccccacatgcacttgactccccatctccctttctgctttatcaccattgaacacatctgtttttcatgtttattttctgtctctcccaagaaaatgtaagtttcattacagcaagtttttttctttattgctgtattcctgatcttagaacaatatgtattaagcttcatgtttaatgaaaatgactgaaaagcttcctaacttgtcttccttctactgatctccccttctgtagtccacttcctcctatcccccaggtagtataccaaaaaatgcatctgatcattctcctgcttaaaagactttgatgggatccccacatccttcggggtctggccccaaatttaatctgtttccccattccccaaaatagttgtacactctccacatactaacacttttatcatccctgaacctacttgtgccatttatccatgcttttcgtgtatctctgtatttacttggccaaagttttattcatcctccaggtctagttatgccatgatgtctcccagaagccttcatctgtgtacccccacagcactcagttcaggcctccattatagtacttgtgctatactatgtatttaccaatctgcttctgcaactagattataagatcccagagagcaagttcatgatgttgtgtccagagttcttttgccagtgcttaacactatacttagcagagaggaaacactgcaagtctgaagaatgaaaatgtaatgaatgaaattttataatgaatgaaataatttgtttatgagaggttgggggaaaaaaagagtcttcctaagagtcagagtgctttacaacatcaaacctgagacctgatatgagtttttacatttgctaaagaaaaatttcctttagtaatttcaacaatagttaaattagtggattcaggaatcagaagtaagttaatggctagtcaggaaaggtatttactccacggaacataccaatttacacaccagatattgtgtggagcaaaaagtgtactccaatctgagaaaaggcatctgcaatttttttaattaaaattgatttaagtgggaaggaaaattgaaaattatctagtgcaactacttcatttcacaaatgaaaaaaatcatgaaaaggggaagagcattaacccaagttagaagatcaggatcagtaccaaggttttattcaaaatgaagggctctctctcaaatgtaacacattacagttccaaactactcaaggattaaagcccagaacttattccattactttgctgtgcaaacttaatgaagagtgaagataatattgcaagtaggaaaataatattgcaagactgaaaataataatacctgggttcttatctaggttgtatttgtgagatctcagacaattcactgaaccttgtaatgctaccttaattaactaccacatgggattaatgtgagaatcaaatgaaagccctgttgcaaatgaaaagtataatcatcttttccatcctcatcctttcaggttctccagtgcagtctcttagcaagttttcaatctatatggggggccataaaccacttgcaattctgactagttggagttttgttgttcttgtagtacaggacagaaagctgcgagggaagggtggggaggttgtttatgtattataaacctcctcccaaaggggagtattatccatatcacctatcaattaaagactctttgagactcacaagctcttaaaaggttcatgttgaaaaattatctttttccccagtacacgccctacaaaaccttttaccatttgtatatttcagaagattctgtaacaattacttgggttatatttatcttttcctactctactacagatgtgtccaaagcagggactcatagtatttcatcttcaggagctgtgaattgttttaattgggtcaacatccagttgaaatataaaactaagtggctggagtcgtgcctgagagaactgaatgaaaaagaactgaacgacgagagaccagaattatacctccctctgatttcccccaactctttcccctctatgtctattatatattgctaaagacctttagaaactaggctctgggcttatgcaaaagtcctctactacattctacatagccacaagtttatttacaagtatttttatattaataacattttataaaatacaatgttttaactccaggtgtgaaaatatttaaaggaaagtacactaaatggatttttttaattattcatctggcaaacaatcttgtgcaaaatggtcactatataacatgtacaaggccaggcgtggtggctcatgcctgtaatcccaacactctgggaggctgaaatgggaggatggctggagcccaggagttcgagaccagcctaggcatacagcgagactctatttctttaaacgagaaaaaaattatgcattctgtgaattccatttacatttagaatctcattctcataaacagtaatattttaatttgtattaaatcaaagcaattgtaaatataaatcataggcttcattttttttcctgtatacacaatatgccttaatttttgaaaatgttataaaaagaatatccttggctgggcacagtggctcacgcctgtaatcccaaaactttgggaggccaaggctggtggatcacttgaggttaggagttcaagaccagcctgtccaacatggtgaaacgtggtctctactaaaaatacaaaaaattagccaggtgtggtggcgggtgcctgtaatcccagctactcgggaggctgaggcaggagaatggtgtgaacctgggaggtggagcttgcagtgagctgagatcatgccactgcactacagcctgggcaacagagcaagactccatctcaaaaataaaataaaataaaataaaaaactgatacattggataactaaaataaaaaattctgctcatcaaagacactgttaaagccacattctaagggaaaatatggtcaagaactcacgtctagaacatgtaagaacttcaccagcttacatattttttaaaatctaatttacaagttgataaagatttgaacagaaacttcacaaaaatatacataagcagctaatgagcacatgaaagagtgtttaacatcctccaacctcagcctccaagtagctaggactacaggttatgcgccatcatgcctggctaattttcaaatttttttggtagacaactggtcttactatataatatgttgcccaggctggtctcctgggctgaagcagtcctcctgcccctacccctcaaagtgctgtgattacaggcgtgaattttcatttaaaagaaattaaattaaaagaaattaaaattacagatgtgaattttaatttaaaagaaattaaattaaattaaaagaaattaaaattcatgcctgtaatcgaagcactttgggagataggggcaggaggactgcttgagcccaggagtttgagaccagcctgggcaacatattatagtaagaccttgtctctgccaaaaaaatttaaaaattagccaggcatgatgaagcataccagtaatcctagccacttggaggctgaggtaggaggatggcttgagcctatgagttcgagattacagccaactacgatagcatcactgcagtccggcgtaggcaaaaagtgacaccccgtctcttaaaaaaaaaaaagaaatgaaaatgtatgtccacgggccgggcatggtggctcacacctgtaatctcagcactttgggaggtcaacatgggcggattattgaggccaggagtttgagaccaggctggccaacatggcaaaatccagtctctactaaaaatacaaaaattagccaggcatggtggcgcatacctgtaattctagctactggggaggctgaggcatgagaactgcctgaactcgggagtcagaggttgcagtgagccgagatcgtgccactgcactccagcctggatgacacagcaagactctgtccccctcccccaaaaaaagaaaatatatatccacaaagacttgccagtgaattttggcagtagcttgctttattcatgacttaaaaaaaaaaaatggaaatagcctagatatctaccagcagaagaaggatggataaacaaactatggtatattcatactactcagcaataaaaaagcacaaactacgggtatctgtaacaatatgaatgaatctcaaaagcattatgctgaataaatcttataccaaagattacatactatattattttatttacatcaagttctagaacaggcataactaagatatggtgacagaattcagatcagtgattgctagaagaagagaataaagctgattaaaaacagcaagaggggccaggcccagtggctcatgcctgtaatcccagaactttgggaggccgaggtgggcagatcacgaggtcaggagttcaagaccagcctgaccaacatggtgaaaccctatctctactaaaaatacaaaaattggccaggcgtggtggcgcatgcctataatcccagctattcaggaggttgaggcaggagaatagcttcaacccaggaggtggtgagccaacatcgtgccactgcactccagcctaggcgataaggcgagactccgtctcaaaaaaaaaaaaccacacaaggaaattttatggagttataaaaatattctgtgtctatataggagtgtaggttacatgagtgtgcatatattaaaactgatcaaactgtaaactcaagatgtatttcatttttgtaaattacaccacaatttaaaaaaacatatttggaccacttaagaataataccatggaggccaggtgcagtggctcatgcctgtaatcccagcactttgggacaccaaggtcaggaaggtcacttgaggtcaggagttcgagaccagcctggccaacatggtgaaaccctgtctctaccaaaactacaaaaattagccgggcatggtggcgggcgcctgtaatcccagctattcaggaggctgagacaggagaactgcttgaacctgggaggcggagattgcagtgagctcagatcgtgccactgcactccctcccgggcaacaagagcgatactccgtctcaaaaaaaaaaaaaaaaaaaaaaggaatataccatggaacctgatacgattgagaaccttaatttaaaaaacactgcataaaaaaggtaaatgctgtcatttcaggtgatcagttgataataaaatgtctacaaacccaaactgaaatcatgcagtaatacatacattaatttttggataatcattaaagaccatagaaaatgtaacagatcctactcttcaaaataattgctattcagtattaaaataaataaagtgaaaggtgttggaaagatagaggaattgataggaataccacagaagtggaagaatagtatgaatatccataaattaatttatattagcaagaaataataatgcttacatcatcagatccagtctcagaaggccttgcttttttgggtgcaatgacaggggaaagtgatccttcaaagtcaaactgaaaagtaaccccaaaagaaaagataaaaatcataaatgcattcctgtcaactgatcaacttaaaggattcagaaatcagttctgccaattatgaaaactgagaaaagccatcaaaactcattttttgatctggaaagtcattatttaaatatctttcttccaggttactgtaaagatgaaatgaaatcatattaatatatgcaaacatctagaacagtgcctgggctcctaaggactgattttaatggtagtttccttccctctcctacttctgtaacaacatagattacatcacatctttggtagaaaaagaaactttaggcatatccacaatataccaagtctcaaaggatcaacccaatatcagtcaaatgttagaactaagcaaacatttatttacagtccacctacagtaaactatctaacaattctatggcagagacaagtagctactctggaaaatcttttttctcctctttctactgaacccacagccagactacatacatacgtctgcctcctttgaagttaggtgtgaccctttgacagagttaattataaatggaagtcactgtcatcacttccaggaccagtccagtcctacccctgctcctccaggctctttgccccttccacctgactggaatgcagtcaaccaacggcaagctttgaaccgaagacaaaagatcctccatcaacctgggttcctgaataactgtgtggcctgtttatctgctaagccctgttatgtaaacaagacagacatttttattgtgtttgagccattgtatcttttgaggcctttctattacaatagtgagcctatcttttaactagtacaactacatcaaagcagttttctgcaagttgctcttcttcaatttcccctggcataatctttgctgccccagctacttcacatgggcattgaccatcaactaataaactgtaactctataaatggcaatggctattttcctatgctgaaaaacttacatatttatcaactcactcacctaaacagagttgatttctatataaaaactaaacataggtagcaataaagtgatttttaaaaccgaatgttattgagagagaagatttgcttgtgaagcattcaaataaaaaacagcccaactcatatatattataaaaaacctggtagtaacagtgaaatcaaagcaacaaatataacagtaactatctaacctaaaacttcaaccaaaatgtaacacacacaaagtcccacagtcaaaaagaatgtccctgctataattatcagattcataaggcctggagttatgagaaagtagaaactgcctgataaggatggctctttgtgccatacatggatctgtttaatcttcactctttcaatgtgtctcaggttagccaaccctgttatatgctcctatggacccttacccttcatctatcataacacatgtatcaaatattacttatttgtttccctcaagacagtcaattccagaggaacaatctgttttgtttggggtatatgtgagaaacctggcatcatgcctggcccacagcagggattcaatatttatctaatgaaaaaaagagcagcccaaaagccacaaaaagttaaccccaaatgcaactgttcctacaatgtacagtccagtgcactcatgtaacacatcagcaaattaaagaaagcacaaagaaatgccaaaaattgtgtaacgagtcattggcagaaattctgtactccaccacattatatatgtgaaaacaaaaagaataaatctgaacaaagcaaaatgaaaaccatttgccaatgaggaccatttcatcctaagctttgactatgaggacaaaagatagcaagggtttaaccacgcagtcctataaataaatggcaaagcaacttggcctcaagaattgatttccttattccttcctttataattatcatgcaataagtaagtcaaagagtcatgtccttctttgcaaaggaaaaaatgggtaggtgctcagtcctccccaaaacatggaaacgcgagggggcataggttctctgccagagactaggacacaacaatctgtactcatcaacaagttccaaggacaatgatacacaaaactacagaaagctgacatgctttttcataatgtagaaatccagtttctatgaggcttaatcttttcacatgtaataaagaacagaaaaattgaggataatgtcacttggatacaattgtttaaaattagaaaagaaggccaggagccatggttcacacctgtaatcctagcactttgggaggccaaggtgggaggatcacttgagctcaggagtttgaaaccagcatagcccacatggcaaaaccccgtctctactaaaaatacagaaattagccaggcgtggaagtgcatgcctgtaatcccagctactcgggaggctgaggcacaagaatcgctccaacttaggaggcagaggttgtagtgagccaggatagcgccactgcattccagcctagatgacagagcaaaaccccgtcttaaaaaaggaaagaaaggaaaagaaaattgtccctattttcccataagatttttctcaaggaaattgcagacagcaattccttcatgtgctgaaatagacacaaactcttaaaaacagtatctcactcagatggaaaatggcattcactcaacaaatgttcactgagtatccttctatgccaggcaataccacaggtcctggagagagagagtagtaaacaaaactaagcaaaaatctttgccttcctagaatttacattccagttgggggaggagggacacaaaacaaaataagtaaaacatacagtatattatatttaattaagtgagaagaaagaaaaacaggtaaatggcactaaaggtatggaggcaggtgtaattctatagagagagacaggacaggcagcactgaggtgacatctgaataaagacctaagcacgtcttgtcggagggaaagcattctccatagaggtaatggcaagtgcaaacactcagaggcagaaacatgctggcagtgctcagggaacagagctgaggccaatgtggctgggatgatgcgtgcaaagcattaagaaataagaccaggaaggtgagcaagggctaggtcacatggcatcttataagcctatggcctttactctgagtgacatgggaagtcactgggggattctacgcagaggcgtgacgaacgcaacctgacgttatcaaacaggattactttggccactggtctgagaagagactggaacatagacaaaggacatgaaatatgaataaaaaaataagaactataaataactgatgaaaatttgaaaaaaccattcccatttacttatagagaaataagataaaatttctcaggaagctggcaaaggttcaccacaccacaaataaacactgtggtgaaatgggcgcttttaaatgatgctagtaagaatggcaccggcgaacccctttccaaacattacttgacctcacagtttctcttttaagattcaattcttgggaagtaactagagatgtggttaaagagtcgtgaaaaaggatgtttataaattacaataacgaaaacaacagattcacaaggtacaattattagctattggttaattatgataaaactacactatgaagaaatgatggagatattttagaaaaaatttttaatgataacgggaaattttcattggtatttttatatagaaggtaacatcaaaaatatttagagtggttatctctgagtagtataattattttcttaattcctccattttccacattttcctttcataattaagacaaaaaacaagttttaaaaatggatttgctggccaggcacggtggctcacacctgtaatcccagcactttgggaggctgagacgggcagatcacgaggtcaggagatcgagaccatcctggctaacatggtgaaaccccatctctactaaaaatacaaaaaattagccgggcgtggtggcgggcgcctgtagtcccagctactcgggaggctgaggcaggaaaatggcatgaacccaggaggcagagcctgtagtgagctgagattgtgccattgcactccagcctaggcgacagagcaacattctgtctcaaaaaaaaaaaaaaaaaaaaaggatttggtgtgcaaggctaaaacatatagaatggtacagctgagctacctggaaaaggggtaattacagtctagagtgattttttttcagagtgacccaggcaaagttgtcctgggagtgatctccaaagctagaaggagatcaccaatactgaggacaccactctgctgattttgtaaataatctaataagggcctgtaaggatgttactgggggaagagggtgagaggtaaggccttataccattaacagagtagatggtataagtacagagtagatggtatagtactcggctaaagtactttaaatctccctcaaatcaaaccttcctcttcacatcccaagcaatatgtgtgtaaaaagacaatcttatcttcagaaaacaatgttaaacaaggagtcagaagatgcagtctagtcatagtttttaaaaaatcacagatctgtgatttctttgtgatccagtttcttcatcaataaaaccaagactatcactaatcctagcataacttgcagtcattttacaaaggtgaaatgagaaatagtcatatatgctttaacattctaaagctcagtaattataatcactagtaaaatgttaatattaaatattaagtgagatttgatttacaacatatagatacaataaaccttaatatcattctattattttgaatatggtacgcctattatgtagtctcaatgttatattaccaattatgcaaccattacattaacagaataactcataaagaaaacaattgtatttacttacatttctagtccatgctaagcggtctgtgttaaaacccatcacgttcatgagacaagtcacaaat

SEQ ID NO: 489 - DNA, 19436 bp, Homo sapiens
caggaccgctggcgccagcgggagaaccaggaagcgcagctctccccttagctgactctggtgctctctacaggtggccttcactatcaactgcacagcgggcagaggcagaggaacacagaaccttctcacacagcgggataaaagggtgaatttggagctgacaggcaaatatatcttgtgatatatttctctggctttgatatcagggtaatattggccgcatagaatgaagtagtgttcctccgttattttttggaagacattgctaagtactggtattatttcttccttaaatgtttgatagaatttgcacgcgaagccatcttggcttggcttgtatttctggggagattttaaattactaattaaatctcttttcatgctatagtcctaagtcgattttctacttattatttatttatttatttattcatttattttgagacggagtttcactcttgttgttcgctcttgttgcccggggtggagtgcaatggcatgatcttggctcacccaacctccgcctcccgggttcaagtgattctcctgcctcagcctcccaaatagctgggattacaggcatgcgccaccacgcccagctaattttgtatttgtagtagagacggagtttctccatgtttgtcaggctggtctcaaactcccaacctcaggtgatccgcccgccttggcctcccaaagtgctgggattacaggcgtgagccactgcacccagcctgtttcttcttgagtcggtaatttgtcttccaagaattttttccattttacctaagttgtttagtttgttggcgtaaagttgttcataatgtattccttttaatttctgtaaggtcagtattaataacccccctttcatttttgattttgataatctgtgtagtcctttctatttttcttggtcagtcaagctaaaagattgttagattttttttttcaccttttcggtgaaccaacttttgatttcattgatttttctgtttcttatttcattgattttcttctactctaattttcatcattcccctccttctgcttgcttgtattaaatacatcagtttaaaacttcaggaataacaaaagatttgtttcgcaaaggaagatttgaaatgttagacatgtagaaatgcttatgatattgcaagtagcagtcatttcgaccagttaaccagaaggaaattcggtgtgctgaaaccaaacaagtgtttttttgtgccgggcttttactgattttgaaaatatcaagtctagtttgtgggaagctgtttattgcatgagcagtttatttttttaatgttttaatatagagaatgcccatgttcactaaatcccacaagtttgtttgtttgtttgtttgtttgtttgttttttaacttaaaggaaagtatgtattaaccagcacatacactatcctctttgtgctttatctctggtaatccttataagagcaccatgagttagatactgttttatgccctttttatggaaatagaatcttagagtgtacatttaagtagctctcccaggtataaccagctggaaaagtgacagaacctaggtctctcagattccagagattgcacacacgaatactatatcacactgcttactgctgtgagttcagcagagaattccttgtttatatggaaataacaaaattgatagtatccaggataattggcaacagtttacaaaccctctttacccccactttggtgattttaagtggggtcatctgtccactaaattaaacagatcttaggctggtcacacttctaaaattgtacaccaagtttgtgtgtaaaggtactttcccagggaaaaatatctgtagatttaatcaaattatccaaagagggttaggcccactacccagtgttccctggatgataagagaatgccatggagcctacacccttccagtgggaagaatagtgccaatttacttgccatttatgttctagtttttaatcagagtgttccagtcacacacacatagttagctatgaggaatatctgcagatgctggttcctccacttcaaacgagtcagctaactctaggtgaagagctttatactttggactatgtggttataaatgatgggcaggtaggataactagaacagtgtatatgctcattaatacatacttatcctttaagtctgaaaaaatgaacttgtggaattcagtgaaaattggcattctaaatattaaagtattaatatttagaattatagatttttagttgggatggtggtataaggaaggtcagcccattctcaaactgggttggaggcataagggacttgtttaacctaacctagtggtgtgaacctacaggaagtagtgatggtggactgagtcatgacttaggtaaagggagatgattctagatcatggaacatgatatagattctagacatgagattctaaactctggtaccaaggcacacattgctaagacaatctgtgatcatgtactctcaagaggatcatatatttcagctgtatagcgccaatttatgtgccagttacgttccagttataaatcaaagtgttctagtaacacacatagttaattatgaggactatctgcagatgcaggcttctccacttcaaacgagtcaaccaactccacctgaagaacttcatgctgctgcctatgtgtttacaaatgatgggcaggtaagataactctttctatttctgccctaattgtgacattcttcgtataattattttctcattggaaagatgaatataaactatatgtgttaattctcttgatttaaaagataaaatatgacacaggaaatcttatgtgaacataaaatgggaactttttgatccaagagtggattggttgtactaggaactgatttattttattttattttattttattttatttatatctttttttttttttttgagatggagtttcactcttgttgcccaggctggagtgcaatggcacgatctcagctcaccgcaacctccacttcccgggttcaagtgattctcctgccttagccttctgagtagctgggattacaggcatgcgccaccacacccagcttattttttgtatttttagtagagacagggtttctccattttggacaggctgctctcgaactcccgacctcaggtgatccgcccacctcgcctcccaaagtgctgggattacaggcatgagccaccgcacctggccgaactgatgtttttaattatcacatttaatgctcatagttgttctgcagatatgtattactatctaccctttaataagaaatcaaggctgacagtggtcaaatggcttgccccatgtgacacaagataggaggtagagccagggtttgaacgcatatctttctgactccagagtctatattctttcccactccccacaataactcctttaatatcgagattgcagtctacagtctctctttctgttatccaagtcactagtgctctgcctaaaaaaatgactaagtattcctcgtggaatatgaagcactaggtgatgttgccatgattggattgtcctgatggagatcttaatgtgagttttgtgttgtgtatgagagagacttactaacttcaccattagaacatgaagacaaaggagattgcatctgcactaggacacaattaggcaataatctcttctgtaacaaaaccagactaaagttattccaccacattcccaaaactcctcaattaattaggcttttccttaattttctgtgcctttattttctcttttttaacaatagtcataagaatcacacctcactcatagggattggccaaggattgagttaatacatgtaaagcattgagaacagtacctggagggtagtaaatgttcagtaaaaatgttttcacacattctccactctgcttttataggaaatgaaaatggtttggaaaattttttaatcaaaattatatatttgaatataattttcattaaatatgctcctgcatatttaatgcaagagcatattctttatttcttcaacttttactttaagtcctggggtacatgtgcaggatgtgcaggtttattacataggtaaacgtgtggcatggtggcttactgcacctatgaacccatcaccttggtattaagcccagcacccagtagctatttttcctgatgcattccctcccccaactcctcccccaacaggcccagtgtgtgttgccctgcccgacgtgtccatgtgttctcatcattcagctcccacttataagtgagaacacgtgctgtttggttttcttttcttgcgttagtttcctgatgataacggcttctagctccatccatgtttctgcaaaggacatgatctcattccttttttattttttttcttttttttgagacggagtcacgctctgtcgcccaggctggagtgcagtggcatgatctcggctcactgcaagctccgcctcccgggctcatgccattctcctgcctcagcctcccgagtagctggtactgcaagcgcccgccaccacacctggctaattttttttgtatttttagtagagacggggtttcaccgtgttagccaggatggtctccatctcctgacctcgtgatccgcccgccttggcctcccaaagtgctgggattacaggcgtgagccaccgcacccggccgatctcattcctttttatggctgcatagtattccgtggtgtatatgtactacattttctttatccagtctatcattgatgggcatttgggttgattccacatctttgctattgtgaatagtgctgcaatgaacatacatgtgcatgtatctttataatagaatgatttatatttctctgggtatatacccagtaatgagattgctggatcaaatgatatttctgcctctagatctttcaggaatcaccacactgtcatccacatggttgaagtaatttacactcccaccaacagtgtaaaagcagtcctttttctccacagccttgccagcatctgtagttttttgacgttttagtaatcgccattctgactggcatgagatgttatctcattgtggtttcgagttgcatttctctaatgatcagtgatgttgagctttttttcatatttttgttgcccgcgtgaatatcttcttttgagacgtgtctgttcatgtcctttgcccactttttaatggggttgtttggttttcttttgtaaatttgtttaagtttcttgtagactctggatagtagacctttgtcagatgggcagattgcaaaagttttctcccattctgtaggctgtctattcactctgatgatagtttattttgctatgcatatgctctttagtttaattagatcccatttgtcaacttttgcttttgttgccattgcttttggcatttttgtcatgaaatctttgccggtgcctatgtcctgaatagtattgcctatttttttttctagggtttgtatagttttgtgttctacatttaagtctttaatccatcttgagtaaatttttgtataaggtgtaaggaaggagcccagtttcaaattttgcatacagctagccagttctcccagcaccattaattaaatagggaatcctgtccccattgcttgtttttgtcaggtttgtcgaagatcagataattatcactgtgtgatcttatttccgagttctctattctgttccattggtccatgtatctgtttttctgccagcaccatgctgctttggttactgtagccctgtagtatagtttgaagttaggtagcgtgatgcctccagctttgttcttattgcttaggattgtcttggctattctggctcttttttcgttccatatgcattttaaaatagctccttctaacttggtgaagaatatcaatgatagtttaatggaaatagcattgaatttctaaattactttgggcagtatggccattttcacaatattgattcttcctatccatgagcatggaatgtttttccattcatttatttgctctctgatttccttgagcagtggtttgtagttctctctgaagaggtctttcacttcccttgttagccatattcctaggtaatttattctttttgtaggaattgttaatgggagttcattcatgatttgtctctctgcttgcctgtttttggtgtagaggaatgctagcaatttttgcacatggattttgtatcccgagactttgctgaaattgcttatcagcttaagaagcttttgggctgagacaacgggattttctagatatagggtcatgtcatctgcaaacaaaggtaatttgacttcctttctccctttttgaatactctttatttctttgccttgcccgattcccctggacagaacgtgtaatactatgttgaataggcgaggtgagggagggcatccttgttttgtgccagtttcaagggtaatgcttccaggtttttcccattcagtatgatattggctgtgggtttgtcatatatggctcttattattttgaggtatgttccttcaatacctggtttattgagagcttttaatataaggggatgttgaattttatcaaaggccttttctgcatctattgagataagcgtgtggtttttgtctttagttctgtttatgtgatgaattacattcattgattggcctattctgaaatgaccttgcatcccggggatgaagccaacttgatcatggggaataagctttttgatgtgctgctggattcagttttccagtattttattgaggattttgcatcgatgttcatcaggaatactggcctgaagtttttttttgttgtatctctgccaggttttggtatcagggtgatgctggtctcataaaatgagttaggtaggagtccctcctttttaattttttggaatagtttcggtagtaatattaccagctcttcttggtacctctagtaggcaggaacatattcttgggttatcctttgatgaaaacagcttttagttaacatacatactatacccttcattttcatgttttatttaccactaacattgtaaagctcgccctacccctacctgattccaagatcaacatatcggaatctccataaggttggaggtgggaaaatttatcttttcaatctatcctacccttcattatctatatgtatcatctaataaagtattaatgattattggttaataagtaactttaaagcactaaaagaggccgggtgtggtggctcgcacctgtaatcccagcactttgggaggccgaggtgggaggatcaggaggtcaggagatcaagaccatcctggctaacacggtgaaaccccatctctactaaaaatacaaaatagccgggcgtggtggcgggtgcctgtagtcccaggaactcgggaagctgaggcagtagaatggcgtgacttggggaagcagagcttgcagtgagccgagatcatgcaattgcaatccagcctgggcgacagagcaagactccgtctaaaaaaaaaaaaaaaaaaaaaaagcactaaaagataaaaaaggtatttctttttttttctcccctaacaagggctgagacaaaatgatgtgtacttcatgagagagataaccatatgtttatacctttggatgatgaaagccactcattccccaagcattctgatttatcatgactgtaccatgtttgactttggataacaccttgtattttaccttcccttgtttcactgagacttgactaaaattagcttgccttttctgagagcatcgtgtatgttcagggatgagaaatctttgacctgtgactaaaacttacattaatgatataaatgcatggctgtgtatgcatatgaagactgtgactttgcagtggttggatttgtctttaatggaatatgttcactgatgtttttcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaaggtgagggggaatccaatctttgggcctcaaccatgtcaaaggacatttgtagtcatgtccttgagggatgaacagatatgagcacatttgcaagtggaagggcaaggttctaattaggtgcaacaatttggagttgttgcaagcgttagatgaatgaagcaggttcctgaggcagaaggagatggtgggctcaacaagaggatgggtctgctcactttctgcctgtcctcacattccgctctaacccagtgtggtctggcttcttagtgtactccaatgaaactactatcatcaaggtcaccagtgtttgctacactttggcgttaatgtctcagcagcatgcgacacagttgtttactccctcctgcacggaaagcttcttgggtccccagacacctggatttcttaccctgttactagagactcattttccttctcttttttgtttttctcctctcccttcccacctctaaatatttcggaaccccaaagcttaatcctagactctcttctcttcagtatactatctatttaggcgatgccgtgctgtcttagaattttaaatgattcacactataagaactctcaccattatacttctacactacaacttgctcctgaaatccagactcaaatacgactacactcgcggtatctttactgggtgtctaataggcatgtaaaattcaactgactctacatgctcaaatttctgacctccctctctccaaaaatactctacttttagctttcactatttcaattaaagatactgtccattaggtgaaacatccacaaaggtgtaacaaccagctgttcacaggtatgggggattgaggaatcctggtttttacagtttgcagctatccatcgggcaaataatcccaccatggcctagttcaagctgtcaacataaggtcactgaaccagattcaggaagagttggcagcactcagctctcatggtcggttgcctaacacctcctgaacacccctggtgtacttttacttagtagttctagtcaaaatacttaaagtcacttatgagttatctcatgattcttttattactctctcatttcccatttcttagcaagtccagcagtagatgcccagtataaattctgcatccaaccatttctctctatgcctccagtgcatgctgccgtgatctgtctccaggctagtacaatgccttcttagctctgtgtttctaatcttcgctcatctatcgcatactctctaaccctgtggctagataattatttcagcacgtaaatcacatcatgccatgtccctcctgaaaacccatcctcatctctcctaagcactcagaacagaccctgaaccggctttggtctccaagcctctgcacagcctggcctctgtcaccctctcctaacatgggtcccatccatttcctcctggctctctctgcctctgaccttcacctctgtagtgcccggtccatccccactccattccctacccttggcctcactgcagcctggaactctccctctgcctctgcacaggaggctctgcttctttctccaagccctgcccaatggcacttcttcagaagcctctgccaaaccagctgcagccccaggggctccctctgctgctgtctcccacaggcctgtggactgcttttccaacaccagcccaatgctgcttgtttcatttgctcattgtgcatgtactgtctgactgccccatgaggatgtgagctccacaagggcagggaacgttgctccctgggctgtttactgctgatccctgggtcctggcatgctgcctgccacagatgatgaataaatgaaagaggcgtcagacctggagtgaaaagaaagtcactttttctagataaaagggaaggatctgtagaatcatataaaaatacagatgtgtgatgatggagtggtgataagagtgttcaactccaatagccacgtgtattttctcagagtatttggggtagaaaggaggcaggttaaggagggctcacttagtctggcttcctgctgtgcacagcatggcatttataggtgaactatacaaataatatcaagtgagaattatcatcttgctgcctatcaagggcagcaagatgatacaaaatgacgaatacaaaaacctgtgaatgtttattctgctgtcgtacttctttactgcatatattcattatgccaagaggtaaaaaggtagttttattgtattatctgacctgatctctgtcacaagatctgagatttccacgtggtaaatccttctgtttcatgaaataaataattctttagaacctgattaatacacagctgtccctctgggggaggatgggacaaaacacacctatcttgcagctcaacctcttcatttggtttccagctgctagcatcactcacaatgtccatgaagagaaggtaaaaaatggccaatctgcacacaataatgtcattgcaactgttccatcagtgcttattagtatggcagcagctggtatttcatccatgagtaccagggaccagtgtaaatttgctcacttgttatactgtcctacgaggattccactacgcaccatatatgcatagtgtcgtgagggaagaaggtaattttgttgtattatcttttctggcctcaattttagggttctcagattgctacctggtatatccttcttctttatgagataatttcctagatactgagcatcagtggggcatgcctgtgccattgacataatgcacttacctcacagctcaaccacttcatttggtttccagatgctgcagtcactcacagcatttgtgaagagaggataaataacggccaaccagtagctgataatgtcttgtcaactgctccaccatggcctggtaatatggcagcagcaggaatttcatccatgagtatgaaattcatccatgagtacttattaattgtactgtcctacttggtttccataagcaggcatattttcatgaattatagaaggtggttttgttgtatattctttcttagcctcaatttgaggggtatcagatggccagctggcatatcctcccctgcttttttagataatttcctagaaattgaacacagaggaatatacctgtggggttgacataatgcacttacctcacagctcaacctcttcacttggtttccacacgctactgtcaatcacagtgtccatgaggaggggatggaaaatggtcaaccccaacgagataatgtcatgtcaaatgttctatcagggcttattaatatgacaggagctggtattccagcgatgagtaccagggatctgtgtgtgtttgtttattagttgtagtgtcctccttggtttccatgtgcatgcataatgtcatgaagggaagaaggtggttttgttgaattatctttcgtgacctcaacttaagtggactcaaatcattatatgatgtattctcctgcattaggggataatttcctagaaaccgagcatcagtgggatatactggttcaattgtcataatgcacatacctcacaactcaacctgttccatcggtttccagatgctaccatcgctcacaatatccgtgaagagaggatggaaaatggccaatctcgaactgacaaagtcttgtcaactgctccaccacagcttgttcatatggctgcagctggtattccatccatgagtaccagggatctgcgtatgtctgctaattagttgtactgtcatacttgttttccataagcatggatattttcatgaaaggtagaagtcacttttgttgcatatactttcctagtctcaatttgaggggtctcagatggccacctggcaaatcctcccctgatttcctagataatttcctagaaactgagcatcagagggatatacctgttgggctgacatagtggacttacctcacagttcaaactcttcgtttgttttccagattcaactgttactcacattatctgtgaagagaagataaaaaatgaacaaatggcacctgataaattcttgtctactattacagcggggcttatgaatttcacaggggctgatattccacccctgagtaccagggatcagtgtgtgtttactagttgtactgacctacttgcttttcgtacgcatgcagtgtcatgcagggaagaaggtggtttcgttttattatcttttctggcctaaaattcaggggtctcaaatcaccacctgatatgtcctcctggtttatgggataatttcctagaaactgagcatcagagggatatacctgtggcactgacgtaatgcacttacctcacagcttgaactcttcatttggtttccagattctaccgtcactcacaatatccgtgaagagagaatggaaaatggccaaccccaacctgataacgtcttgtcaactggtcccacagggcttattaatatggcagcaactcctattccagccatgagtgccagagatctctgtatgtccacttataaattgtgctgtcttacttggttttcatatgcatacatagtgccatgaagggagttaggtggttttgttgtgttatcgtttctggcctaaatctgaggggtctcacatcaccacctgatatatcctactgctttatgaaataatttcatagaaactgagcaccagagggatatacttgtgagttggcataatgcacttacctcacagctcaacctcttcctttggtttccagatgctacagtcactcacaatgtctgtgaacagaagatggaaaatgtccaaccagcacctgataacgtgttgttgactcttcgaccacggcgtattaatatgacagacactggtatttcacccatgagtaccagggatccatgtaagtttgtttatttgtattactgtcctacttggtttccatatgcatgcatagtgtcaaaaagcatacaaggtggttttgttgtattgtcgttcctggtatttcacccatgagtaccagggatccatgtaagtttgtttatttgtattactgtcctacttggtttccatatgcatgcatagtgtcaaaaagcatacaaggtggttttgttgtattgtctttcctggcctcaatttcaggggtctcgtatggcaacctggtatatcctcctgtttatgagataatttcctagaaactgagcatcagagggatatacctgtggggttaccataatacacttacctaacagctcagcctcttcatttggtttccagatgctaccatcacttacaatgtccctgaggagaagatggaaaagggccaaccccaacctgataacatcttgtcaactgcttcaacagggcttattaatgtggcaggagctggtactccagccatcagcaccaatggcctgtgtatgtttgcttgttaattggattatcctgcttggtttccatatacgtgcatattgtcatgaaggggagatggaggttttgttgtatcatctatcttgagctcaatttgaggggtctcagatcaccacctgtcatgtcctcctgctttatgcaataatttcttagaagctgagcatcataggggtatacctgtggggctgacataatgcacttactcacagctcaacctcttcatttgttttccagattccaccgtccctcacaatgtctgtgaagagaagatggaaaatgaccaaccgcaacctaataacgtattgtcaactgttcaaccagtgattatttatttgacagcaactggtattccgggcatgaataccagggatcagtgtatgtttgtttactagttgtagtgtcctagttggtttacatatgaatgcacagtgtcataaagggaaggaggttgttttattggattctctttcatgagctcaatctgaggtgtctcagatcatcacttgctgtatcctcctgctttatgagttaatttcctagaccctgagcatcagagggatatacctgtagggctgacataatacacttagctcagagctcaagcttttcatttggtttccagatgctaccatcactcacaatgtctgtgaagagagagtggtaaataaccaaccactacctagtaacgccttgtcaactgttctaccagggcttgcttatttggcaacagctgatatgccagccatgagtaccagggatcagcgtaagtttgtttactagttgtggtgtcctacttggtttccatatgcatgcatattgtcatcaagggaagaagacggtattgttgtattatgttttctggcctcaattttagggttttcaattgctccctggtatatcctagttccttaggagataaattcctagatagtgagcatcagagggggtattcctgtgggattgacatactgcacttacctcacagctcatcaactacatttggtttccagatgctaccatcattcacaatctgcgtgaagagaagaaagataacagccaaccaacccctgataacgtcttgtcagctgttacaccagagcttattaacttggcaggagctggtattccacccatgagtaccagggatcagtgtatgtttgcttactagttgtactatcctacttggtttccatatgaatgcagtatcataaatggaagaatgtggttttattatattgtctttcgtgagttgaatttgtggggtctcagatcgctgcctggtatatcctcctgctttatgtgataaattcctagaaactgagcatcagagggatatatacatgtgtgcttggcataatgcacttaactcacagctcgacctctttatttggtttctagatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtgtatgtgtgttttttagttataccatcctccttgatttccatatgcatgcatagtgtcatgaagggaagaaggttgttttgtgaattatctttcctggcctcaatttgaggggcctcagatcatcatatgatgtattatcctgctttatgggataattttctaaaaattcatcatcagtgggatatatcggtggggttgacataatgcacgtacctcacagcttgacctctccctttggtttccagatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtgtatgtctgttaattagttgtactgtcatacttggtttacatatgcatgcatattttcatgaagggtagatgtggttttgtagtatattctttcctaacctcaatttgagggatctcagttgtccacatggcatatcctccccagctttcttagataatttcctagaaactgggtatcagaggaatatatctgcagggctgacataatgcacttacctcacagctcaacctcttcatgtggtttccagattttaccatcactcacaatgactgtgaagaaaagattaaaaattagcaaagagcacctgatacattattgtcaactgttacagcagggcttatgaatgtcacaggggctggtattccacccctgagtaccagggatcagtgtatgtttgtttactagtcgtactgtcctacttgacttccatacgcatgcagtgtcatgcagggaagaaggtggtttttttgcattatcgtttctggactaaatttgaggggtctcagatcaccacctgttatagcctcctgtgttatggaacaatttcttacaaactgaacatcagagggatatacctgtggtattgacataatgcacttacgtcacaagtcaacctctttatttggtttccagatgctaccgtcactcaaaatgtccatgaagagaggatggaaaataaccaaccacaacctagttatgacttgtcaactgttctaccaggacttacttatttgacagtagctggtattccggccatgagtaccagggatcagtgtatgtttgcttattcagttgtactgtcctacttggttttcatatgcatgcctagtgtcatgaataggagaaggtggttttgttgtattatctttcatgagttcaatttgagtgttctcagatcgccatctggcatatcctctccggctttatgatatacttttctagaagctgagcatcaggaagatatacctgtggggttgacataatgcacttaactcaaaacttaacctctttatttctgttccagatgctaccgtcactcacaatgtccatgaagagaagattaaaaatggccaagcagcatccgataatgtcttctcgactgttccaccagcatttattaatatggcagcaactggtgtttcatccatgagtaccagggatcagtgtaagtttattcacttgttgtactgtcatacttggtttccatatgcatgcatagtgtcatgagggaagaatgtagttttgttgtattaccttttcaggcctcaattttagggttctcagattgctacctggtatatcctccttcttaatgagataatttcctagatactgagcatcagaggggtatgcctgtgcggttgacataatgcacttacctcacgcccaacctcttcttttgtttccagatgctgcagtcactcacaacatccgtgaagagaagataaataacagccaaccagcacctggtaacatcttgtcaactgctcctccatggcttcgtcatatggcagcagctggaatttcatccacgattaccagggatctgtgtatgtctgcttattagttgtgctgtcctacttggtttccctaagcaggcatattttcatgaatggtagaaggtaattttgttgtatattctttcctagcctcagtttgaggggtatcatatgtccacctggcatatccttgccttcttttattgataacttcctagaaactgagcatctgagagatatacctatggggttgacataatgcacttacctcacggctcaatctcttcatttggtttccaaatgcaaccgttactcaccatgtccgtggagagaagataaaaaacggccaaccagcatctcataacttcttgttaacccttccatcagggcttattaatatagcaggagctaacatcccagccatgagtaccagggatctgtgtatgttttcttataagttgtactttcctacttgatttccatatgcatgcatagtgtcatcaagggaagaaggtggttttgcggtattacttttgcttgcctcaatttcagggtctctgattgccacctggtatatcctcctgctgtatgggataacgtcctggaaactgagcatcagcaggatatccctgtggggttgtcattatgcacttacttcacagctcagcctcttcattttgtttccagatgtcaccgccactcacagtgtccatgaggagaagatgacaaatggccaacaggcacctgataactccttgtcaacggttccacctggttgtattaatctgtcaggagctggtatttcatgcagaagtaccagggatctgtgtatgtttgtgtattggttgtactgtcctacttggtttccatatgcatgcatagtgtcctgcagggaagaaggtggttttgttgtattatcttactcaaacttagtttgaggggtcttggatcaccacctggtgtatcctcttgcttcatgagataactccctagaaactgggcatcggagggatatactgtgggggtgacataatgcacttatctcacagctcaattttttcatttggattccagatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaagtaagtactgcaagaatgtctatcaatgaaagcatgagaagtgtctcattctatgatttagaacagaattgagctgcctcttgagctcattgtttggctgaattggatctatatataatttagcatggctttactttaatttcactgaaaattgctaatatgtctgcttaagtgttttgttttcctttgttagtgttcacaatagtttccttagtaatatacagatgtcgtgatttaagcattcaaaacaagcactatgtaacattgtagcccatgaaaaatgtatactgtggtagtggatgcactaagattgaggtatatttcatttttgtaattgtagaaatactaatttttaaaatatcttcagattatgaaagaattttcattttgcttgaagaggtacaaggatctatgaaagtcaagagacaatttgttgaatttaccatcaaggaagcagcaaggtgagtgcaaaaaggaactgtgctattgttttaagcacttgcgcccaatttgggacaggggcaggaaaaaatcatggtttgttcctcctaatccctggccctcaatcatagttcatgctatttccacaggcatttaggttgatactatcttattctaacactttcttccaataccatggaggcttccaaatttatcaaaatctgggagtgtatgtgggccctcagttgactcactttgtatttttctagtttgtatctttcaatgaggatgcattttctgtttgcatgtagatggtaaattctattttgtatccactctacctcttacatctcatagatcctgtaggtatcctctggtgaatggaatacctctttaatttcaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgca

SEQ ID NO: 490 - DNA, 507061 bp, Homo sapiens
  misc_feature (357877)..(499876): n is a, c, g, or t
atgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccccggcggcagcccgcccgcgcgtcccatcccaggccagagtgcggcccccacgctcgcgggcggcgggggcggcgcggcaggcagcaccccgggttccccggttttcctctccgcggccgcgggcagcaccgccggcagtctgcgggagctggcgaccagcaggaccgcgccggcggcaaaggtgagtatctgtctcggcggaagtggccacggcacgtgggagtgtgtgggtgggtgcttgggcgtggggggcagtgatgaggtgcggaggagaccacgggtggtcctgcgttggcccactccgctgttgctcttcctccaacttcgcttgcttggtggcggcatccggcccctgggcagctcgccgcttgttcacgtgtgtcccatcctcctgtggagtgggcacgccttcctgtcccgtcgctcacccccgattccttggccggacttgttaccctgcctcttaaacttagcatcgcccttgcgtctccctagaaacggggaccttcttcctctgggtccccagacactccctctgcacaccctgggcctgcctagagaaaagttagcccttaacgtttctgacagggctctgatggctgctctgggaagcccgcgggcctcctgcctgcggtgtggctaaggaggggagggcagaaggcagagtgggactggggtttggaggaatgcttctagtagtctggaaggagttaatctggaggccccaggagccttttgacccagcccttttggacttggcagtgtctaaccagaagccaaggtcttctcctgggctcccaggcagggttgcattcccacgggggtcatttatatttattattattatttttggtacagccgcattttagggccttcgctgcttctgttttagacgaaagatcttctctggatggcttcaatgatttggttttaaaagcttcttacagcttcttattacacacccttgccaccttgtgaacagttaccaggagagagggcatgggatgctggtttaaatgagaaaagaaaggacccgggttttgttaatttctttaaatggagaaaagcacttaaatgttaaaaaaaatacattatctattggaataatcatttgctttagaaacacaactttattcctctacttttgaccatttaaggagttggtgatgcctagtccttccactatgtgtaatcctgaaatgctgggaacattctagcacctggattaggcagtactgcaaatctctaaggttaaggttaggaacttaaacccttggatgttgagcttgagttaaatgccatactttgctgcaatgggtttttttttctatggatcaggaagaatggggacagtcaaggatagtcactgggggtcacttggggggcactgctgaaggggaatttttttctttggttttaattgtgattaaatccagctaaatgcttgcgttagaaattttcaaacttttccttcctggccttgctgtttttgatgtaaggtatttataattaaatatctttatttgcagaataagtgggttaccttcttctgttctgataaattatgtgatattcggagccccgcttctagtaaaacgctgggacattctgatgaccatctgtttacagatgtcctctcagtttatcttgggggactttgtgtttgaccaggaggttaggaggtaacctctgacatgtgacaggctgaagctttgatgccactccgggaattctgtggcatttgtagtaccttttagaacttgtcaaaggggttgaagcttggaactttttagtagtgacatttagtattagcaggaaattgatgttttactcaccatatgttgagacccttggttgactttctttatgggtgcatagtcatgttcatgactttttgtgtttttgggatgtttctggatgttgtttaatagacgagcacttatttaactaataagcaggagtcccgcatggtgtattcacactacactagcactatactaccatgctgggataatagcattaggtccagcacatgcttcgggagtgggaaggattgtaatagcatatcaggcattgagcaaccctatacagttggttgacaaagatttcggctgaaaattacttttggtactttactgtccattggaattgcttgactcctgccaggaaagttgaatgctggatgttgttgcatgttgtttaatagaggggcacttatttaactaatatgccatgatagcaggtaaccataaatattacagtcccatcattttccaattagaagctccttacatcttcttttgggccaattagggtatgtatactttttaggtatataggtaagtattggcatagcttgtttactttattaattttgttacggttcaatattttgacagctttatttaaaaaaaagttttaatttctgtttggttttactggcaggacacaaaacagtgttttcctgaactctttacctgttgtttttcatcggttttggtgatcaccagagtacttggagtcccctgacgtggttagcagaacctctcagctctgctctcacctgagccatttgagataaagcgcttttgtggagtcagttaacgatgctgcccctggaaataatatacccagtgacgagtacccatagcctaagatcaggagttggtctttttatttgcctgttggcaaatactatatgtgtgttgcttcttaaagtgtgttcatatgtgttacttcttgaagtgacctttaaacagtcctgttttaatggtactgtctaacccttgcagttgctaatgtatgctaaatttctcaggctaacttgtttgtttattgttttgttttcactattttgcaagaaaatccctttaacatcccaagctagcatcaatcaaattgtttcagtgcagtgggagtcttgctaaaagagttttgtggttccacattgagtaattcaaaacatgctttttaatgtaagtgatttaataaggacttgaatatcagacaattccaattttgttttgaaaattttttaaatccttgacttatatttgagcctatacagaacatcttctgcagttcatgtagactcggctaggcactattataggtaaacaagactggcttgggctttctggatggagctgacagtagaggtagtgagtggttgcaagctgtctgcccagctctcagaaggtacccgtgggcactgaccggtgtcactccagaattctgtgagggttacaaggaaggacattgtcacaaattaaagaattctagaaagcttaggcagtgcctttgatgatataaaagtcggcattacagcctaataagtttatctgtattttgtatcttgaggtacagtggtatatgttcacattggatccgtttgaaaatctcttctgtgtctctttgacaatgtgactgggacttaatagagaaaataatttaagttggagaatcataaaattatatttgttaaatattttattttataagcatacacgtgtatgattcttccaccattttttgagtacagagctgaggacctttctttgagttccagattgtctttttagctgaacacagtcaccttttatgattttctatttgtttctttcaaatagagtgaagactaagattttcaaaggattctgaatagagcgtcatttagattttaaataggacctctccactaatgtttgatgttctcatttacacctgatttgaccattttgttagtgtttgagtctttcatacatggtcatcttgatttcccaagggacaatttttttttttttttttttgcactcaaacttctttccctgttacagactattgaattatggtgcatatttagcattatgagtacaacttgcattagcatagttgggaataaggacaacagatccctgataagcacaggcttccccaggcaggagtggctggcccagccttgccaggctgtagtctctggtgggtgtgggtgactttggctgtgttacagaggacgtggaatgttggttagtccagctggtcagctagtggaggccaggatagagggtgtctatggtatctggaagctagttaccatgttctttgggtctcgacagttgaactgcttatatacccgagattttctgttgaacatttactgagtgcctgctgcatgctgggcactttgacatatatcaccttatggaaagttcacaataatcctgccaagtggctggtataattattattttgaggcccagagagattgatatttgggcaagtcagagagctaggaagtgattgagttaggattctgttcctccgcccttctgtccagtttggctggatggttgggatgttgtcgtggttcggtcttggatataataaggactccagaggaaaaggctggcacttgggggcctcaccaaaaaccagacagctcacaagagaccaaacgagtggttgatatgacagctgagttacagcaaagtcctgttcagaaggcccctgagtgtggaaacagcagtttgcagccagcgagtgaataatctaaattattatttattgagcacccagtgggaccaggtgtgaatgaagcctctgctgagggctaagggttgagcggtgttttaagtgtggctcatctggtccttactgcaacttggtgaggttgctagttacacaggtacggaaattaaggctccagaatttccttgctgagcggcacacagttaatgagggtgttttttggaagattaactttggccttggttagaagagtcctcttactctaccacaggctcagctcgttggtagcacgattctaaacataagcagtggccaccccttccattcaccgtgcctcacggctgcagatgctcttctatgcaaggctgctgtcttgtaaacccacagagtgcacagagcagtgtggcccacaggaaacagcatcaaatctgttgtggctttggatgcaggtgacaggcagctctattaatatgtaagtgacatgaacaggacattagtctgagtggcctagctggctaacccagcagctctgtgctctcctcactgatccatacttggtctgcccttctgctctgctcctctgttggcttcattctcatccctacccagtaggtctcaaatagaggccgtggcttcaggtgtcacagtcccatgacaacacccagtagtggagacagcagggtttcttccccttgtacttagtctccaagtcggtgagcaaacggtgacccagccccaaccccatgtttcttgttacacccctggggacagtgttgcctcccaggctggtgtctgaagcccacacacaggactgccttttctcctgaggcggtggcctgccacctcccccaggacacgtggaaggaggggaaggggtggtgggaatcccactgaaggtggttttaatcttggcttccacacttcctcaccatctgccccggggcaaatgggctagctttcctgagacttgttatcagtgaattagggatgctatctgcttcttagataaataggataacgtatgtgcagtgcctggcacacgtgattggctgtcgtttcagtgcctgttcctaatacgaaaatcttcaagtctcttatcacgcgtgaggcacacctcagagtgcctgctttgctgctggtggatttgtggtatttagtattctaagttaagggtgtgtgcgtgtacgtgtgtggatgtggatgtgcatgggggggtgtgtgtgtgttgtgagtctgatatcatgctttgcctctagattcagtcagtccatgttgtggaaactggatcgtcaagcattactgggcatctatgcggagtagttgcttgagtctgttggtttcctttttaaatttgctccaagtttatctttattatcagaggcagtgttcatgattcttacaaacttcattaaaagggaaaaaacgtctaagccataatctgctttaaaaaaacagcaggggagaataatcctgctcagttgctgatccagcctgttggcaggctatcctgaaaacgagcccacctccgtcatccgtaggacacaatagcttgtctacagctgcctagaatcaggctgcttgctgtgatggagctgagcagaattctatccaattgtttcttcctcctggcttttgagagcctgcctgcttgctggagcatgacagattcggggctcagttttgcaattgtttctagtgtgcatttccgtttgatctgtatttaatctctatcttttacagttaacatgatcttttttgaggtgcattaaaaaaaaacacacacatcagcaagcatttgctgggggaaatgctcttgatagcaccacttgaagaggccaaggtcaatttttatcagatttgccttgcttgggagatcttcagatttgatgaatgtgaaatgcatgcttgatgggtatcctattggaattttaattaactttaaaagaacagggtgtcgagctgaaggtattggcaacagtgaatggtttacagatcatgcaggcaccccataatgtgagcctcccttttcccattgagtgaagttggaatgaaaaagtgtataaagttgcagcatgatttgtattctgctttctttaggctctcctggcccttgatggctctgcacatccttggaggccatttagagctgcagctctcctttgggagacctgaaggaggcccaagaagagtcactgcgctcttgggtagcacgtgtttacattgttaactgatgcaaacgaagatatgatggtatttgcatttccacttaatgtaatgtgtgcataaggctcacatgaatttatgtgagtttaaatgaattaggattgaccacaggaattcggatcaggaggaggtgtgagagaatttagaagcatgcttgcaccggggcacctgtaaatgtgctgcagccgggctctctgagagcaagacctcaccagagaatcagggagttcgcagggagccatctttaccctggttcaaggaatgggatgctgatgcttttctctctctggcttcactgcacagatatttaagtacctgctgtgtaccatacactacagtggacactgggggctccagggacagcgattgcattggtctctatttataatgaaatgtaattttttttccatttagttaggtgaccagatatgctgcagaggaaaacatgtgtctatatctttttattctctgtttatctggcaggaatttctaatgaggaaagtggtattggtgtgatttggggcttagtgagtttgcagtgggttctcacctctttttgtttattcttccatagtctagatttgccaaatgaaggctttgcacttcttctttctgaatctttctgactttgtggtggggaaagaagatgatgaggcaggtccatcccacagctggaggctttctgagagcagcttggtgttgcgggcagcacctttcagagaagctgtctgctgtttgctagttctggagcagatgctctggaagtgccacatgctcaggagataagagaacttgctgctgtggctaggacgatggaggtcaggagtgtccagcacgttttctgaagattcttttaattttttgttggccatcaaagcacaccaccttaggtgagaattatttggatttatcatttaggatctaagatacattcatgggtgactgcattccatttgttgctctaggatgaacccagagatactggagagaaagaggaaagatgagggaggcttaggcacatttcagtaaatggttgcaggttaactaatctcattagacaccacccgtcctgatcagccgttgtttttgcgttcaaagactaatcggttaatcctccaagctttgcctgccactgttgctgtttgatttgaagggtcaaggaatccttcagatgattactaaacacttggagtgctcacccatgtgggttgaggaaagtactcctgaggctgggccagctaaatctcaggccaggccgacttctggaggtgttgcctgtgtggagtgcctttacccataaatgcaatggcagacacatacatttatttcgcagatcaaaatttctttttttttgagacagtcttgctctgttaccctagctggagtgcagtggcacgatctcgactcactgctacctccgcctccagggttcaagctattcttctgcctcagcctcccaagtggctgggactataggcgagcaccaccacgcccggctaacgcccggctaattttttaatatttttagtagagagggggtttcaccgtattggccaggctggcctcgaactcctgacctcgtgatccgcccgccttggcctcccaaagtgctgggattacaggtgtcagccacttcgcctggcctctcagatagaaatttctaaaaaatctgtagggagaaagtagtggggtttcagttttgcatgtgggaaaaacaaaaggcttgggagtttagctgtaaaagaaaggacagttgctgttgttgctgggacttcaaggctgttgtaaaaattagcttggtgctgcatttgctggcaaagtggcaagcaaattttgagtaatattctggacttcatgtattgtattgaactggatcttttagagaggggtcagggcagcccctgggcagcccgctgctgctggttcattctagtcttcctgttcatctgcagtgaggaagtgggtcactcttcctctgggtctgcacaccctgcctgcagactgcagctgtagggaacacacagaatgaatggtggcccaggtgctggggctgtggagctgtcaccatggccctgtgtgagtgctgctcttgaagactggcccagaacgagtgatgttaataattaattcagtccacacatatgtactgactgcccaccctgttgcaaatactgtgttaagcactggaatatacattgttcacaaaaccagaagtgatccaggcctttctgcaactgaccattcagaggacactgtaaacaaatagccaataggtatctcttgacatgtggtaataagagacatgaagacaaggggccacagcctgatgatggcaggggacgtggagtcatgggtgatgtctgtggatttaattatgcagcttattttatttatcaaaatgtatccacatctttactcttttatggataagccactggattccttaactctttataatcatatcccaaatctgcgtaacttaaaaattgcatcctattttctcttcccaagcacagccaaaggtaattaaaaccagatgtgtttgcatgagaaaatgcgtgcagagcatcaagaatgtagattgtgctaaattaatgtcgccttaacaaagatagccaatgagactgacctttttttttttactgagttcatgatgcccatgggttaattttgtcactagcagtcattgtctggaccaagtttgtagtctaaacatgtgcagtatgaaaggtgaatgctctcacacagtcacactcctaataggaagacaactctcttgtatcctgagcggcatcccccttgtgccttctgtggctgaatttgtgttgtggactatagcagagggaaaacttccaatgctagaaatctgagttttaaaaattaatttaaaaatgtgttccttatggaattgggagtgtatctgctgtctcggtttgacaaactaagctttgacttgtgtacagtaacaagagttttcctggatttaaagttgttgtccccagcatatcaaatgaggtgacgtatatcagatcctgtggttgagcctcacagtgcagaagggcacctgctatgggtcagcagcccattgaacaatggagtttaagacttgcagtttttgagcttttcaatcacctctttgccaaagaccaatgtgtccattgcttggcagtttgacatctggagtcgtgtggacaggggtctacatccaaaaggcagcgccactggggcttagtttgttcaggtttgtgttcctaggcagatggaggctgtttgtctcaaatatagctgctttaaaaaaacaggagggtttattgatcagaggtagtgactcatgacgttgaaactgtgcctacataactcacatgacaaggctggggtgaagaggacaggtctgcggaaggctttccacttagtcctgggaggccccttttccctctgtccaccgtcccctcctgcaccatcactgtcacttcttttctgaaggctgcattgatgcacatggttggtgcatatgggtcgattgatgcacgtggttgcatgtggttgacgcacgtgtttggagttctctctcttcctgagatcagctgcatccagccatggaccttctcttttgccggttctttgtgaatcataaatctacttataatgcctttacatactgatgttctttttctatttttcccagacttcagaaatttcttgcctttttttttttagagacggagtcttgctctgtcccctaggctggagtgcagtggtgcgatcttggctcactgcaggctctgcctcccaggttcacaccattctcctgtctcagcctcccgagtagctgggactacaggcgcccaccaccatgcctggctaatttttttgtatttttagtagagacggggtttcaccatgttaaccaggatggtcttgatctcctgacctcatgatccacctgcctcagcctcccaaagtgctgggattacaggcgtgagccaccatgcccggccaatttcatgctttttagatttatgggaaatagaattttttcccttctgcaaaaggcctatgtgctctacacgtggttaatagccagtctatgcaatatgattgatgttaaaggtaacatctcctctgtgtccccaaactaatcagtgccccatcttagactatcaacacctacacagtctggccccaggggtatcagttttccacttggtactatcactgctgtaaacaacttcatgggctgagaagcccttactttcataacccccaccttccatccggggctgctgtgaactggacaaccctaaagcatcctgacaaccagactcctgttgggcaggcggtatctggctggtgtgagccatttacatcagttgtattgaagggatcaatgctatgctgggacccatccttggtgctcattttagtcgacttcatccaggtggaaagatgcaaccacaccccccggagcccaggtttctgcggattcctctcttttgtctcccttctgtgcagtttctggctccatttttatttgttcaggctgtttcagtgacccttcctcactcttcccctctgtgggccgtgcgcattcctggcaaccagtgctctgtcggcttttgcagttgccactggctggctttctggaggcagcctctcgtctctgcctgggtccctcttcctccaacttgctcagtgatgagtggggctcagagcctcactcacaggctgccctccgcaccgcgccaagctcatgggaggggctcgagacctctgcagcacctaggcacatgcctgcctttcccagtgaccaggcccagcccagagctgagcccacagctgcagagatcaccagtccccaggctgaccaattctttacaggtgtaggctgaagctccaacccactgcacttttctctatcgtgaaatcggatgtgaatttagggtgcagatcccaggaagagtgatgacgcctggggataacagtgtgtcttgacagaagagttaggacccaaagccagcatctcccaggagaaagcaaaatagtcattttctagaccccggggaacaagtctcctgacagtatcaacaggagggggtactggttggagaaggaggtcagggtgacggttgtgtccagctcagcaaagccaggtcctcgcctcctttcacccatgggaccccccagatgtgccagtctgctgtcggctgcctgcttctcctacctcctgcaagctctgcaggtggcagggccctttctacactcacggaagtctcaaacaaacttctgtgacacctcctctggtgtgtggccatcatttccagccccctgcccaagtcctcttctggggtccttgagtctcctggggggggggtctcaggtatgtgcctagaacttctgctgcagcccctggcctgtcccctgggccccaccctgagtcacctaccgggtggggtccctgagctcctggagagcagcaagggaatgcttcccatggtccagccccctgggcggactcttgcgcctttgtgactgggtgagctgtgcatttccagttctttgccagctgccccacctccccacccacatcccttccattggtgttctcaggaataggtgtttacagtcttattttttcttaaaaattcccatgcatgttatattctactctaaaatgtgcctcctctgattttaataggaccccaaagcaccctgtggggttagctccacaaacttggaatcaaatatgtgtcccgtgacttcttcccattccctggcccccagcacccacacaggcacccagcttgcaggcacagcggccgagagtgagggaggggctgcctcctgggctccccagggacaacggggcactctgctctccccagtggctgagggaggaggattctagtcctgtcaccagaagcctctctgggttctctgggggcagaacgcctctgcttggctgcatcttggagccctccatcctggagtcacctgtgaggtcaactgagcggagcatgggctgtcgggcctgggtttattttctgatcgttggtgtcctctggcttcacctgccaaagcatcgaggattgttgttgactgatggaagtgctataggcttgtcggtaaatgtggggaaaggtggctgtcattgtgggacgttttcactctctaaacttaagtgggaaatttctgtcaggttgaggaattgtcaaggatgtcggctttcaaggtgacaattgtcgtgctgacagatacagcacatgggtggtagtggagtgccgggggcttggggctggtgtcctggctgctggagtgtgatttggcactagagatgaggaaagggaaagtgccactgggatgctggtattcctggtggtgtccctgagcccgggaacccagtgtggggggcctgccatgatggccacaaggtaacctcaggaggaacctgggaaacgttttatattaaagttttcatttaatggtccattctgtttgtcaagtggtgcatatagaaaaattgtggcagttgcatggaatttcatttggaaacaaatttaaataaaaagtgagtcaatttaaaggaactcattaagtaagtatcgtgaaactgaggcttggaggaccatagtttggataaaaaatgccttaagttgaagtgaaatcagaacctcaaagcgagatgtgcaatctcatgttcatttcagcattattcacagggccaatatctgaaagcaacccagatgtccatcaccagatgaatgataaagaaagtgcagtgggctgggtgcagtggctcatgcctgtaatctcagaactttaggaggtcaagacaggaagatcgcttcagcccaggagcttgagaccagcctgggcaacatagcaagtccccatctctacaaaaaataaaaaaagaaaaaaagaatcagctgggcatggtggtgcatgcctgtagtcctagatacataagaggctgaggtaggaggatttcttaagcccaggaggttgaggctgcagtgagccgtgatcgcaccactgcactccagcctgggcaacagagtgacaccctgtctgaaacaaaacaaaacaaacaaacaaacaaacaaaaggctgcctgtgctgtgctgtatacacacacacacacacacacacacgtatatacacaaacaatggaatattattcaatcttaaaaaagaaggaaatctttccatttgtgatggcatggatgagcctagaggacgttatgcgaagtgaaacaagccacagacacagaaaggcaaatactgtgtgatctcattcatatccggaatctaaaaacactgaattcatagaagcagatagtagaaaggtggttacgaggcgccggaagtgtgggaagaggagatacttgtcaaagagtaacactttcagttataagatgaatgaattctggagttctactgtgcagcatggtgaccatagttaacaatactcgattatatacttgaactttgctaaaagaatagattttaagtattttcatgacaccacgaaggtaaccacgtgaggtgatagatatatattaactggaatgtatatgtatatcaaattatcacttgtataccttaaatatatacaatttttatttgtctgttatacctcaataaaacaggggaaatataaatttaacatgataatgaaaagtacttttaaaaaacacacaaagctgcctcaagtcatagaacaagcagacctagctttcaccatgacgtctctaggtttgttctttcagccctggtttcctgtgtgtctgaaggctcacgcccagctgtggatgtgctgaggctttgtatgagggaagagtttgaacgaggtgaatatgaggaacagggcaattttatgcttgcaagcagcgttgggaaaattgctttgtttgatttttaaacctaaatggcaaacatgagaaacccagcctttgggatttattttggacatgacaggtgttccccgagtccttatgccactgcactgggtccaggttgggccactcccaggcccacctccagctggtgatgcatgcctggcaggggccacctcacactgtctgcatcagtcaggcaccaggctggagcctgagccacagcagagcactgacccggggttgagaaccaagagacgggcagggggcggaaggcatggtgggaataggcctcgctcagcaagctttgttcccagagctggggtgctggggcggtgtggacactgcgcactgtggggtgagcgcgttcagtgccgatctcagggcagcgggctcacacccggctcctgggctctaacaggtgtggcataagaaactcagggctccgtgtcaggaagggccctttggagaagctcgtaagcagagtgttaagggccctcttacggggcctggagtcatctctgagtcttccctcaccggctctgtctgtgtctccaggtttggtcatttctttctcttgtaaggggcagttcactcctgcctttctgctgcttctgagacagagccgtgtcctggctgggtccttcctgaccacggtctccccagtccatctgtgcctgtggccccggtgattgtcttaaaatgctgtttggtggttacaagcccactcagccccctttagtccggacttcatgccaggtttgcagtcccatggccctgctcatgaccctgtgagccctgcccctctcttattcctgcactgtgttcattcctgctgttggctctttgcttatggaagaccggtcgccttcaccattggtctgtctgtccgtgagggaatgccgcctcctttctcatctgtgggaggctgcagagaagccctcatgaaaggggctgcttcctcacacatcctccacccctaggctgtccggggggcctcactgttgcacgcatggtcgagcgacctttggcactgctatcgccatgcgtttctagactctcgtggacttcctaaggagcacttttctagaatttatcttctggttgttttacaggtcttgggtgttctcacaggtcaggaccacaccatccgttgagcctccccacccgtgtgaaagggcgggaacccaggagcagtattggtttgttggttggcatggggtcaggggtgtagtggccagtggcaatgcttccacatcaccaggctgaaaggcaggacggagccgcagagctggggaggctgcgtagggctatgggtgtgcgtggagccctggagcccgaatgcctgggttcatgtctccctccccacacattgttgctgtgtacccctgagcaagtcaaggggcttggcagtgtgacctcccggccgcagtgtccttgtctatgtgggccgacggagtccatgcgggccgagggagtccatgcaggaaaagtgctgagagaggtaccagctgaacagttagatttagtgaaggtgaggtgtcaccactgttactgttcttgagtcttaagttttcattagaatacgtattagaatgcatggtacactaataatggccattattattggagctaacacttgttggtcacttagttctggctgctcttatagccagattaagggtcaggcaaagggcatcagtaaaggtccctgaaatgttactgggacaaattgccaaagggatcattccagcttcccaaaggtggccagggcctcaagagcaaaagaatactagtgactaatcactcctctgtatcactggcccatttctgtggagtctgtggagtcttcttgcatcaattccgtgccaagaggcctccagtgtggtggacaagctcatgggtcctgtgaatgttcaatggcaggaggaagggcacttcctagcactttcttgtttctgtttaggatccaagaagcctacctctgaatgcacgctctccccagcaccaccttcaggcccagcccttcctccaccatgggtctgcaccatgggtggctgactgaccatctccttgaggctgctttggtccccaaagtcaggctgggaccctgaggaagggcctggattggggggccccatagagtctacatctgagtatctttttttacaatccttccttcgaaaacttgcggatctctcctttctttagtgccccccccattccttctgttttcctctgtcctccccttcctaaccctcccctcccctcccctccctctcttcccctcttctcttcttttttccctccccccccccccccccgccccaatatcctatgaaggcctcagagtcctgttagaaaacacttctggcagtaactgttcccatctttcctcctgggcccttccctgggactcatctcccaacctgatgatgtctcaggctttctcctaagtagaggctctgccctcccaacaactgtccaaacaagttctcttcttccctgtctcgttttcccctcttggtgaccctggagcgagtcagagggtgggtttctttttgtccaaaagacagaggttggctggcacttcctcaaggtgcctgggagaaaagaccgggatgcctggactttcttggaattacagctgtccgctgctgctgagaggtttgctcgaaagatgtaaatatgggggtgtggggaggtggtgctgctctctctctatcagaggcacatcagggaacctcaaatgcttttgtggacgagactatctctgcgctgataagcaccttgttgttgctggggccagatgaaagatagttgttgagttgcagcttcagtatgctgtttgtatactagagaaacatcatatctgtgcgtatttataattttccatctaccacttggtcaacagatctgataagaagcccacacttgaaggaattagcactaaatggaatgctaaacatagtaccgtaaatggtccaaaaagaggcctagtcaattattcaggagggttatatcaaggtctcatagcgtgttatcgattcccagttctcttgaaaatgatttatttgtcaattgcccatgaagtgacctttcttgtatagtttccggcttctgggtcttagggcactttggttttgtaattttaatttctcttctaaatatttacgaagttaacaagcagttgttttagctaaaatatcccgaattggagcctagcccattgatctgtcatttaataactcctgtagatgagtatgcatatgcatttccatatatacatataaagttagaccttttataaactctgcgtttatagttattgattggcagttcatctctttaaatgaagagttttggggactagctcatttctgctgatctttacaggtttgcttaagatctgtgggcccctcaaaatccatggtatcatggacaaggtcagtcgggtggtttgttgcatggtgactgtggaattcgagttcagggaagggaccatctggctgggctgccagccgggtcctacacagccccctttgtgtggccttttggtctcatgcacccagtatgcagtgtgttcttaccgatggtggaaacctggctctcccacctgcctgctctaggactcaggcaaattgggtaccttctgcagtatctgttttctcttgtgagatgggccccgatcatgccacatgagcagagcacgtgagggaatccaccgggacggtgtgctgcagccagcccaggccagagcgccatccgtggttcttcatgtcactatggcagagctcatgagccagccatcatagggagggcttcttaaaggcgttctttttttccctttttggacaaattggtaagatgctgtagctcaaactgtgtacaaatttctgcacgtgtgggctgatactttggaagaatgaaagaagggttgagtaattggctctggggaatattactgctgactggtgccattttgatgagtaatagaccccattagatcacagtaaaatactcgattatgtataattaaagatggcattagtcaggcagaagccacagcgtttaaaaatgtgaaagggataatttctaatgctgaaaagtgcattcatggctgaagaagcagagcgtaatgtgtagtgaattgagttctgaagttactggggctcggtcatagacagatgcttgtttagcaggacagctggtgttcttttatttttaggtctcaaaaatgtgtagggacagcaatcatggcagtgtttttttttaaaaagtattttaggtgaattcatggcttgtggaacaattctgattggtggttttacccaaaaaaaatcaagttctagactttattctttgtggagcagacagagcccaggcaagctttgggaatctttgtttccctgtttgcacttctggctttcaactgcagatccccctttctcttctcatttattcatttgctctttccttccttcagaggcttcaattgagtgcctcatgcaggccagacactgttctgggctctgggaaggagcagggagccaagctgagactggcctaggagctcacattgatggagtgggcaggactcagggcagggccacactgctgtccttggtccacacccactgcttttattcggacttctctagtcagacactaagaatgttctatggccccccgggacccgttctctgggagatccattggcttagagctgagaagtctctttggcttgacttgagctcctctactccatttaatcaagagtcaagtgtctggcagagactttcgttattaataacgtagctattaatattcacattgacagtcatttgcacttctaaacctctttaatctcagaggttgccacagcatttcatggacctcagatgaatggcttcaaaggaaggcacagggctctctaccatgaggacccaaggggaattcgcttgtttgacagagcaagtgtgttaaggcagccgtccctgggtcttgcatgcaaggtccagcaggaggacagctgagcatctccctgcacgtgtccattgagcacccacatgtcctttggctctctgtggcagcagcaacgttgcagagagcaagatagtctggcctcgtggtgcttacgttctaattggtgccatgggggctctatcaagacgttgtgagtaagtgacaattggaaaaccttagctacagtggagatgctttgtagtgcaggtatttttgtactccagttggacttaattaagattaaaataccagggggttctttttctgctcgtggatattttttgtcccagtggaaggttgaaatcactttttaattgcagctgtgttcttttattaaactagtggttcttgacttggggtgcatgttgaagtcccctggggaacctccccaaacactgatgtctgtctcagcccagggccctgtgatgggtctgggtgcagcctggcatcagattcaacggtccccaggtgatgccagtgctggggtgagcagcactgatctaaactgcagaaggccaacaaaaggtggtgtagaggaagtggttgtgagagccagcacctggagaatcctgccagatctgcacctggaagatgagttggacatggccaggtaaagagggaggaagagtgttccagcggagggaatggcaagcatggaagcctagggtcctgaggagcttggagcaaatgaaaggaggggaagggttgggggagggggcatgaggctggagaggatggccgaggcaggtggtacaagaccatgctagggatttttgtctataacctgatgatagtcgaagccattttatttatgagcctggaactactctgctcattatttcacttaaaaaacaatttcttagaaaaatagtttttttacaaaaacgaggaattcaacttattaattcacttagtctgtttaaccacacagtgggacaggtatagataggtgctatgattacccccattgtgcagacggggaaagtgaggcccagagaagttgagtagcttgtcacacagctggtgaatcgtggagctgggatctgagctcaggctgcctctggttccagtctggctctacatttctgggggattggtgcgatgagcctcatttcacagagcaggaagtggaggtgtgggttggggttagaattctgttctgatctcctcaaatctcacactgttacctccttatcaggctgttcagacttggggagaaattaaaaaaaaagttttgtgcttttaccatactataaatgtgaaaaaaaatatgggcatataagtcagtgggagagctttatggctgaacataaagagcattcaaataaagaagctagttatttcaaggtgctgatgggggaagtcaggtggtaccttttccattgctgaaacattgatgaaggtcgacactgcttatggagtgcaatgcaagggagaggcttttatggataatattgcatcattgcacaaaagccaacagccacaccaatgtatttgccctgcatttggtgaggggtggtggtccttgggttcttgcttatatttgatgggttcttgattcacaaagtgcaatgaatatattgaaaatatgtgtccagtggcccaggacactgaggtatctgtgctgtcttcttgtccgaggctttttcatgtttgtggggctccatgtttgtggccatggaaacagactgaatacagaattttttccttcctggaaatctgtgcctacacgtctcagaaacattcatgaaaagctaatggtttaacaggtgttcaaataaaccatcctttgatggttcaaattcctaattttatactccaaagcagcaccatccaatacaaatagaatttgagccacatatttaatttaaaaatttctggtagccacgtcacaaatggtaaaaagaaattggtgaaattaattttaagaatatatttaacccactgtatccaaaatatgtcggcatgtagttactatgaaaacttattaatttgcatcctttcatccatgctgagcctgaagcccatgtgtatttcacccctgcagtacatctgaggtcacacttcccggtttccagggcccagtaggcatgtggtgcccacaggtggctgctgtatggaaaggctcagctctgacggatcagaccacttcagatatcataataaagttctggcaccagtgcactttttatgactctaatagatttgcatctgcaaattgtggtttataggcaacaatatgacatttcctatgatttccgaattgtcatcatgatagaatctgcagaggactgcaggaatttttggtttgaagttaatataataacagcctggagggcttataaaatgcatgctgagaaattggtctgaaacccagattgaggatatttttcatacccagctgattatttaaatttcccaatgggaagttattacttctctgacaagtctcatcagcagtctattttcagtggtcttgatggacatggagtctaattttgtttttctcctagcctctttttggagaggatgaaatttggtgtctggaattacatttcttcctaggaaaagtgctcagcgtcttagaaataaattatcacaaaactgtcacctgtcaggtggttcattttccgaggtgacaggcagtacctataatcacgggaggtgggcatgttccccttgttgttgtggtgtgtctttatagttgtggggaatgtgggtgggtggcctgccctttccctggtgcatttggcaaatccctcttatattgcttttgttagctgacatgtacagcaaatcaaataaataattctgggctccgatctcaagttgagaacgagagcataatagccttgttccgggtgcctgatgggcctacagtggcattacagcattcagagcgaaagctcatttactggaaacaacgaagtgtttgaaagttcactgcatggaaattggatttttgcctttttattatttacattgtgtattatcagatttatatttaaagctgtggggattatcattctctttaaacggcattatttaataaagagtaagcatttcatggtttcaagactgctgaacccagctcatcattggaaattcaattaatgggttccaacttgagtaggcatgggcagaggggcgggggggacccagtgtcccctcccaggcccgatggcctgatggtggggtgcctatcaccgtctctcacatgggccctctcacagtgaatatcacctgtctttcaaactttaagagtaaatcttagtacttgctccttgttctcgatggaggcacgcaattgaaagctttaatctctgggatgaaaacttctgggaaaggcagtactttagtgtgaagtcattgttgttatgatgcagctgagtttgagcctgtcttagaagcacgttttgatgggcagaaatggacccagtctacagacaagggaccatctgcaaagacaagacagtcactgtgaagcttttgtcagaaaacccattcccaatggagggggaaggaatcagtggggcaaatatttcaatggaacagaaccagcatctaaacttatgcactgcagcgttctgctaaaccctgctatgggtgaggctgaatgagtacattcatttctaataaaagaaattacattaattcttgaagggaatgtaggtgtttaagctgtcactggaaacccatttctgagaagaagctaaaattgcatgcctttttttctctcttcttcttagtgatttaaaaaaatttgtatttttgctgaggtttggaaaggcaattacgctgattttgcccaaaatttggacagattagttctgctgagaaagaagtaacgaaggtatgaaaggacatgaaataactgaaacttgccaggagaaatattaaggtcaaaagcagaggaagcatgggctcggctcagtgtgcaatgccttatcaccgggtcacctgccccaggaggtgggcccgacagatgccctgtgtgtgtggaagctgccgctgtgaaagagtgtggcatagtaaaacatgagatcaccccagttattttatttctgacacactgggaatgaatcttgatctagtctccagggtgtgtacttgtctgctgtgcgttttgtgctgagctgggttctggtgcattttggctaaagccacattaaccaccccccgacccccgatgccaccatcttgctggagctgagatttcctgcagacctgcttcctgagggctgactcctggtctcccactgctctgggacattagcagtcgggacttgctacaccagttgcagggccgaggacaaaatgaagtgcaattataaaattattaagaatttcattacgtgaccacagagcattaagccaaatttgggcggcagccaagtgacctggtcagtgattctggttggtggacatggaactgcagacaagaaccttctgtgttgatgcatcaaagtatgaacactgtcaatatgctgtggttgccagacttttatctcgtgtgtttaaaactggtttctagagctttgtcttggttagggttcaaaatgtcatccctacatggggctcagcagatgggtctaatcaggcctagcatccatgtggtgctttctgtcatttctggcctcacttgggtgaccacattggatggaagctgggaaatggagggaccaaggaagggagcccctgtttcccagcttgggtaggtgattggggttatcatggagggggtggttttggggaagcttctgggtagggagtacagatacacagaaggccccccagcgctgctgccattgtctgccagtgttgaagctgcagcatcatgggcacggctcctgggaagggaccaccagcctttttgaggggccaggcctcgaggcttcctcagctggcttgaattcttcactggtgaagaaaccaaggctccctaagtttgaattggccctagttcatggccagaagcccactgaaggtcacagtgccctggggtctgtctttctctttgtcctggcttctggcctccaaatgaatacttttggccttgctgtagtgctggccagggtttggacaaggtcaggtgggaccagggtttggacaaggtctgtggggggtgatggtagggactttgggccatcccttagaagtctcagagtgtatgtgtttttggagacctgtggtgacaccaacctgctgcatagagccttctgaagccccactttctgctatggccttggattgccctaaggaaattcttcgggagcagagcgagctccagcttcctcaggtggcctttggagagtgttggctttccaaatcacgacttgtcaaaagaggctttccagatttcaggacatgttggattgatagccagccttcataggagtcatttttctgttgggttcataaaatagagtggagtgtgttctggtgtgctcatggaagctggggctctggcctccctccgggccagggcaagggttccatgagccacataaaggcattttgcaaactacaacttgctatgctgatgttcggtggtgttcggcattttgcaaactacaacttgctatgctgatgttcagtggtgttctcatccatgggcaccttgcatctatgcctattttatagtatttgtggaataattttcccattttaagtgattatagagttggaagttggatctttgttttgttttgttttagagatggagtctcgctctgttgcccaggctggaatgcagtggtgggatcttggctcactgcaagctccgcctcctgagttcacctgccattctcctgcctcggcctcccgagtagctgggactacaggcgcccaccaccacgcctggctaatttttgtatttttagtagagatggggtttcacggtgttagccagggtggtctcgatctcctgacctcgtgatccgcctgcctcagcctcccaaagtgctgggattacaggcctgagccaccgtgcctggccggatctttgttttgatgacacaattttggctatttgtgatttatttcaagcagtgcctggcctgtaactccatcttgaattgtaacactgttcccatgggaactttgatagggtttctagcagtacttgagaacaaaaagggagttcccacatcctgccaatgttgatcatagcacacgtgctggtgtgtgtgaataacgtagaatggaagatgttccagaactaggtggtcagccttcaaactgctaaagctttgttataactattttggtagctgtctttccaagatggtcatatgtattgtaacaagtgctgtattggatcgggctaaggtttccttggcaactcaggatcattctgcatgctgtcactgagctctgcagggattctctggggccccagagccccatgcttcccactggggtcattttgcccctgcctgaaatcacccgtactttgggaagctgggtcctctcctctttggctgccactttgcaggatgctgcctgcttgctagccatcctcccaatttctgcattgtctgatttgcagtccatctcagcagtttggagctcagcttcttaactcagtgaattagcactcggtgttgagttgtgggttgagggggctggcagtgctgccttggctcacacacagtccaaccaccagagatcgagttgctatctcatcttcagtgttttctccgcccctcgcatcttcccctgctgggactgtgctttctctcctagatggtgatcttgctggagaaggaagtatccactcgggtgtttgtttctgaacttttgagtgattcaggggagaggatacactaagggatgaattttaaggtttttttttttttgagatgaagttttgctcttgttgtccaggctggagtgcagtggtgcaatcttggctcactgcagcctttacctcctgagttcaagcgattcttctgcctcagccttctgagtagctgagattacaggtgtccaccactacacctggctaatttttgtatttttagtagagatggggtttcaccatgttggccaggctggtcacgaactcctgacctcaggtgatctcgcctcggcctcccaaagtgctgggattacaggcatgagccaccgtgcccggcctgaattttaagttttttaaaaagggatgtgaagggttgttgtaggagatagaaacgtaggctctctgctgacctgattgccagtttaaaactagacctactcacagaactgaggaatagaggaggcagcttgtgatttattgctaatggctaatggaggcagttaatgctttctttccagttcaaatactatttcttatttaaagactaccaataaggttaataaaggtttttatttccctctgaaatcacacataaatgacatattactccaggtcatttttccatcataggatttgcatcatctgactgtgggaagggctctccttggtaaacacaggtggctccaggctcatagcaccccacaggaccttcttaggttttaggatgagagcacttgaatttgatgtcccagagtgttagaatgttatcagaggggatcatagtattgactggggatattcaccgtctcttctactcctcagctctgctggtaggtctagttttaaacttgcagtcaggccagcagagagcccgcattcctgtctcctacagtgatccttcacagcacctttttaaaaacttaaaattcaatattgcattacaaatattgcattcgctttatagactcccacgtgccatccataaaaatcatttaaaaaggtgaatatgtgtaatgttgccttgaatataaatgacattttcaatctgtaaaaataaaatatctgcatttccatactctctggacaccctctggatctgaaactggccttagagataatctcattgggtcttcaagaacatatgaggaaaaagatttccttggtctcatctggttgttaaaagaaggagattggaacttgggcttcctgaatcccagtctagtgtgcttcctagccacctgaaagggatataaagatgtgattcagttggttactgagctgcctgttttatcacctacaattgaatttaataggatcatcctgagatgccatacaaatttcttgatgtcatcaacagggactttgccctcatcatccagagggtaaaaggacacctttatcaggattgaggattgtatgggaggagcactgcaaagcatgtccaggattaaggccacacagctctcctaggagaccctcaggatggcttttctctgtggcagctgctcgtgtttgatttgcaggccgctaatacaaatccactgtttagtgacgagggagtacttgccttactagtaagtaaccctccttgagcccgtggtatgttctagttctgggctgcgtgcttcaattgcactgtgtcatctggctcctgagcctggagctggactcccattttacagacaagcaaacagaggtggcaagagggtcccatagctagtaaggtgccaagacaggactgtgacccaggcatgtcagacttcaaaacacacgactgcaagctgtgctgggaaatgattgctctggggaggacactgtcctcaggctcctgtggatgactgacaggaagtccagggccacctccaggctcccggttgccacttgtctctttctggtacaggtgaatcagtgatggctttggggactccctcaacgcttaggtgtcctcttctctcatcctggggagaatccagtgtgtaagtgcaggagtctgcatggcttgccttcgtgggtcattgggcaccatcctggggggcaggttcagctgagggcaggttcagtcccccaaggctcagccacttcatccttcacactgaaagatgccttggctgggggagctggatggtgtcatgtccagaggcgctcagggctgtctgacttgcagacagagggtcttcacctcgctgcctgggatgataaggcttgtgtctcaggactttgaggcttgagggatctaagtcgtgagagcatccctatttcttctgataagagatttgaggatttctgagaatcagatgtaattatgccacatcatggatgaatgttttaacacatattctggaagttgctaagtgtttctttcaaagcaagtagcaatggctgattcccgagtgtgcactctggaccagccctggtctacatgctttatgtgtaaaagttcagtgtgtccttatgacaagccagccagctgtgaagtcaaggcgggtggatcacctgaggtcaggagttagagaccagcttggcaaacatggtgaaaccctgtttctactaaaaatacaaaaaattagctgggtgtggtggcacacgcctgtaatcccagctacttgggaggctgaggcaggagaattggttgaacccaggaggcagagggtgcagtgaacccagatcgcaccactgcactccagcctgggcgacagagtgagattcggtctcaaaacaaagaaacaaaaaggtgcccttacacagtgttcacccatgagaaggggactcaggtacagagcagggtctgagccgtggtgccaggctctgctttgagcttcccctccctgtgctctgctgctggccttcctgcatgggctctatcccggcgcagctgcctctctctcaggaccgctgctgtaccgcggtttcctcgtcctgccgagagggtgctgcctgccctgcccagccccagggcgagggtgtatgcgtgcagaagggacttgggaaccagggcgggcatgaggctgttggcatttctgtaacggaggcctcctgcattactgtggattttagtgggggaagaattggcttgttttacaagtcagctttccttgttaatgagctttccttgttgctcacagcttattgtccatgtagtgagtacagttgagaaatctggctgttatttatgacaggggtacccaatccctgggccatggactgataccagtctgtgccctgttaggaactgggttgcacagcaggaggtgagtggcgggagagcgagcaaagctatagctgtatttacatcagctcccatcactcccattaccgcttgatttccatcttttgtctgatcagattctcacaggagcacaaaccttattgtgaactgcacatgcgggggatttaggtttcacactccttatgagaatctaacgcctcatgatctgtcactgtcttccgtcaccctcagatgagactgtctagttgcagaaaagcaaactcatggctccaactgattctacattatggtgagttgtataattatttaattctatattacaatgtaataataatagaaataaagtgcacaataaatgtgatgcgcttgaatcatcccaaaaccatctccccgccaggtccatggaaaagtcatcttccatgaaaccagtccttggtgccaaaaaggttggagactgctgatttatgacattatcagtcaatttatgggcccagagtgtcagacctgggccaggatctgcatgggccaggtgtcaccaggaagtcactctctgccctcaggaagctgagggtcttgtgggatgaacagccaggtcagtcggtagctgctgagcagggtgacccatggagtgtgacagacaggcatgaggttgctgcccaagacagaggaggccagagagggctttcttggggtgcagcccatgctttgttgggtgagaaggcaagaaacacatttgtgtgcccaaagcagggcagggctaaagttggaaatggaaatgaaggagcaggtagccatgcagccttgtgctttccagcaacagggtggacacttggtcccaagaggacgcagctgaaagaccctctggcagggagaacgtgtgaggactctgtggtggattctgagttgtgcctctctggcttaatctcatctgattctagcagtaactccaagaggtaagcacatttgtgagtcctgttttccaatggaaaagctacatgaggcccaccaggtcccagaactcaacaatggtggggctggggttcaaagccaagatctctgactgcaggggctgtgctctcagcctgtccctgctcctactctgggagctggtctggaagggtttggggactggctgagaaatgtgaacatccccaggggctgaggcgtgatgctggaagaggtgcatttggggacagtcatatccagctgtaatggacagggccaggagaggctgcaaggctgcaggtgggccactgtggcaggagttgtttgagtgtctggggattagaggattagagcctcaaccaggggtgtggctgagaggagggcgtggcaggggctcagagaggtgggggatccctgggagaactgagcctggcactagcttggatgtgaaggctgtgagagatggagaggcagaagtaggtgagggtgcttgtgatcacaaggcaatcgactgttcatttagaagagaagccgtttgaggcttcctgatgtatccttgttactaggcataaagcatgagcaatgccaacaagactggttctttcggaacaatagttaaatcctgggggcaggtgagaggtggggaatccccaccttataagtcaggcacgagtatgcagtgatgagttgagtttagttcagggtgctacagagttaggagtgtgtaggaagacaaggtggggctaagtgtggtatgcacgggtttctctctcccacctaccagctgggtgactccaggaagaggggcagcctcctgagccttcgtttcctttctgtccagtgggaatgtgatgcttcctgatggtctgttcttcccctgtacaccctccctggagcatggttgggtgacgtgcattacatatcgtaaggcgatgtttcctggggaggggaacatgtcttagtctagcacctacctaagtctgtggaagttaataaagaaaaaaaaggtttatttgggtcacaattctgctgactggaagactgggcaactggcaagggtctcaggctacttctgcttgtggaaggcgaaggggagctggtgtgcagagatcatacagtgagagaggaagccgggagcaggacatgccaggctttttgtaacaaccagctctcaggggaactagtagagcaagagctcactcaccaccacccccagggagggcattaatctattcataggggatgcaaatacctcccatcgggccccgtccaacattggggatcacattttaatacaaggtttgggggacaaatatccaaactatagcctatcacctatcactcagtggtgcctcctggggaggggagggttgggggctgtgtatcttatatgtcgcaggtgtctaaagcgtagatggtgtcagaaagtacttcccctcctccagccccctccttgggatgtgtcctcaggatctagagggagtttatggatgctgatttgggaattctgctggctggcagagacaggagctgaggatggacacctgcttgttttcctttacaaatgctttggctctaacattgacctggaaagacgccaggacagataccatggaccttactttatgtgtgcctaggcttgatctccttagaaagtctcactgaagacaagtggtggtggagcatctcagcagagctgttaaaattcctaaaaggcgctggtgtaaatacagctactgcgagaagttgctctgacacgtaagccctcagagagccgggcctctctcatttttcccctcttagggctcctcaaccttttttaaatttatttatttatttttaattttttttattatactttaagttttagggtacatgtgcacaacgtgcaggcttgttacctatgtatacatgtgccatgttggtgtgctgcacccattaacttgtcatttaacattagtccctacaaaggacatgaactcatcattttttatggctgcatagtattccatggtgtatatgtgccacatttgcttaatccagtctatcattgttggacatttgggttggttccaagtctttgctgttgtgaatagtgccacaataaacatacgtgtgcatgtgtctttatagctgcatgatttataatcctttgggtatatacccaataatgggatggctgggtcaaatggtatttctagttctagatccccgaggaatcaccttttaacaatgagaataatgtttagccccttggctgggtccttttctcaccttggtattgcagggttagagatgattaccaaaaaaaccacctcttggtttttggcttggtggtaagagcctcttggctgatgcctttcaagatagctgaaattgtcacctctccaagggatttgcaccctctctgactgagggactcctttgatttggagggaaaagtcccccaaagtctgtatagtgatagctggggcactgatcccgccaaataggaggctgaagttgagaataatagagccttgttgaccttggcagcttttccacagtggaattgcaggacccagcaaggagatcccacagagtctgagaactgagctcacccccgaggcgggaataggaactcgcgggcagctttggcacaagcccagaactatttttggtgtgtggtgtgttgactgtagggctctgccatttgtttcttctctaatgaaacaggtgattaccgtgttgaaagaaaggaaattgcaagtgcaagtttaagggccatcaaagggcggactggagttctcaatagattaaccaagagcaaatattcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcctggccgcaaatattcttaagcttggagacttcacgattccacagtgagtaactggaatcgccatcctgtgtgcagtcggcagctcaggataagaatgaaacttcttaataatggctctgcttccctccaaacaatgtgttttccatgatctctctggtctattaccaactatttgtggttggaccaagtatgaatgaaagaatgcacttagagtttgatagatgggctaggactggtttcagttttgtgatctggatatgtttttgcttcttgatgtccttcccttccccctacatcctctccagggctttagtttgtttgttacaatgagattctacatgatttttgtatttataaatttgcttctaaggtgaaccccactggctgtgggggatggaggaggcctactcttctcttgtgtctgttaaatccttaaggaattatttttggtccaggaaaactctgatgcctctctcttttttttttcttttactttttttaaagagttggggccttgctctgttgcccaggctgaagtgcagtaacatgactgatcataactcactgcggcctcggcctcctgggctcaagtgatcctcccacctcagcctccctgagtagctaggactacagcacaggctgcaacccctggctaatttttaaaaattttgttagagatggggtcttgctgtgttgctcaggctggttccaaactcttggcctcaagcagttctcctgcctcagcttcctgagtagctgggactacagctgtgagccacagtatttggccctatttaattttatttttctgtagactcttcggccaagcctggctgtttcccagtttacagctagtatttactcttctacccattcaaactttcaccttttctagaactcagccaggcagcaatgtgatggtaaaggtgtaaaaattggatctttgggagggggaaaaaagagcacttacttgtatcaactgccagtttccaaggtgtaaatactcccatcatgatcaatcaggctaccaatgtgatatcacctggcttgcagaacctctgcaatttaatagtcagccctggcaagctggcaaaaactgccactggcaccctattgagccaggaagtgagtttctaacttcccctttcttcctgtttctaatcaaggctgcaagttcctttagggtttcaaaggcacttatggatgatggtcatgacactacaactggaccattgcaaataaaaatgacaatggggaggtcgtaattgtttttctttttaaagcctcttcttagtcatcgtcttccttggaatataaatgaggaaggccagtttccttcacggaatcattttccatctctgttggcagtgggcctggacagaattctgtgttcttactcccagggctagttgttcctggcttcccccctcctttagtaaggacaaatgaacttaggtcatcaacttgctgcctaagccacattaaatcatcaccctcaaaagctgagggaagactgtgctaatcctgcaaagaagtctttactaggtgtatcaagaaggttcagagtcattttgcaggaaagagtaactgctggtgctactggcagggccactgtttgcgttttctcattccctccctcatccttcctgctgcaaacaggagatgttggcggatgctgtccattgacagggtggttggagaaatgaggatggtgtgctcagagaccccaccacccctgctagaaggaaagttaagtttggatggaaggggaatagagagaagtcttaagacaggagctgtcaaactatgaccagcagtagttgggacccagctacacttgctcacagatgccttgtctgtgggggactgtgtggccagcaaaacccagaacattttgacccttgacagacattgccaactctgccttagagcactgtgctgcactgaccacaggagtgaaaaggccacacttggagcccacatagcaggtcccccatggcctggtggtatggacgagtggggaggctttctgctgcccccactctccccactcagatccttcttttttttagttacttaagaatcatcatttagcatgagtgtgttaaatgagtttatttcagcacatttcagtgcatctgtgactcaccctagacattcagtgctctacgtgtgcccaggctggatgcctgtgcaagaagaccatgttgtttgtgacatgggtggtcactagttttatgttttagtgtctgactttagctctgtcttcctttcctttttttcccgctgctattgcattattcatttttccttttcccccagtttgctgctcattctgtagatacataccttggtgagcctcactggagagctgtggcacctttcagagtggagactggtgggggcagagcttaggaatgggtcaggcacaaagaagtagtgcagacttcttaatatggttggctttttccctcagtgctcagtgtttcaaaggaaagatgcaggccaggcacggtggcttatgcctgtcatcccagcactttgggaggctgaggcaggtggatcacgaggtcaggagatcgagaccatcctggccaacatagtgaaaccccatttctactaaaaataaaaaaattagccgagtgtggtggtgtgtgcctgtagtcccagctacttgggaggctgaggcaggagaatcacttgaacgtgggaggcggaggttgtggtgagctgagattgtgccactgtactccagcctggtgacagaaaaaaaaaaaaaaagaaagaaagatgcccttcacctctatgtcaagctcattggtagtgttacagctctctctgctcaatgtcagccatgctgagtcatggaagagtcagtaagaaaagattattcagaaaaaatttacagaaaatattttgagacattccagtgagggagtgaaggggagaagtcctgagcagaaggaatcgagggagcagaaaataaagacctgaagttctttttcaaagcaatttggaatgtcttcttcctttttccacatcttattggtgattgccataggttctggcatctagcttcagttttcaactatataggttaaaactgtaagtacaaaactatacttaagtataaaactataatcccccatatatgattttaacaagatttttaagctatacattatacttagggcttactactttaaaacatgccattactgtgtttatgcatgcaacatgatgcatccataaatctaccttcttgtaaaagggccatcccctttgcctccagcaagctaagtagcttgagcaatgctaaaagaacaatacacaccactcatcggtgtcccgtgggaataccatggaggtcaggccagtgggaacccagaagttaaattaatagcagaactgcttcaggagtagttctagtaagtgttctttatgatatggttcctggcatatgggatttcatttttccattttttccagaaccaggatagccatatttttaaaaaggatgatggcggagaaaagtggcatttttagaccaaaatgtagctaccaatttatgtagctgcttgacaaatcataggtacaggagatgcggtagaaccaattagaacaagacttctcagcacttgcaggtggaacatgaattgaattattagctctctctgatgcctggaccatatttgatataaaagtattggggagacttgaaggtttatatcctggcaaggggtgatgattggtagaaataacccccaggctaggagagctggtgtcttattcattatttcctgttttacattgtatttccccagtcatcccccattggtattgtttagtgtctgaattcttttatttaattcatttatttatttagttgtttatttttgagacagtgttgctctgtcacccaggctggagtgcagcggcacgatctcggctcactgcaacctcagcttcctgggttcaagcgattctcctacttcagcctcccgagtagctgggactacagacacctgtcaccacgcctggctaattttttgtatttttagtagaggtgggattgcgccatgttagccaggatggtcttgatctcctgaccttgtgatccacccacctcagcctcccaaagtgctgggattacaggcgtgagccactgcacccagcctagtgtctgaattctctccacttgaccgtaagcttcatcaggtaaggagctatagttgtgtttattgttgtatctttcacatgtagagaaacatttattaaatgttgaacatagtgatacaaggtgatctctctaaatgtggcatgggagggaagcctgttctgtgcaaagtctctgtgggactttcatttactaaaatgaaatcatcctacacacccaattaagacagggcttttatgatgcgttgagtgcctccttgttaggcttaaattgtgtgctttcaggaagccaaaacagcaatgaagactgtgatttgcaaacattgcatcattgggttacaaattcagagcttttctggagagatcaaaactatacattttcaccacctgatggggtctgactgttgggaaatgacattcctgttcttgcattatttctggtcatttggtgagtgatctcagagtgcagggctgtctttgttcagaacccagctatcaggagtgagatgaatggaaaaatatgatgacttcaagagccttgctaatgctagctagattcctgtgcttgcgagatgggctcttggcaggagggagagggcaagatgggctctcagcaggagggagagggcttccctgttcagagggggaccttctgcaacatcttcttacacttgaccttagtctcttcctacttctaatcttcggactgtaatgttgcccagactgactgatctggccgtaggtggtaagaatcttacaaatcgatgccatggactggcagctgctcaaactgaaaacctttcagtcaggagttcccttctcttgggtctgttgtgatgccttctggcactggcttctgagaggccatcagcactgttggcccttctcattgccttcttcacagtaggaattaagcctgaacagtagatctctgtcttcctggtgggcaactgtgttttttaagacctcagtgagagttgtctttggaaacaaatgaatggaacgctgcatgctggcctgttctctgctgtatcttcaggactcctgagccaaacctgatttcatcatcttctcgagggctcagtacacattgagctgtcacctgtggtgtgtggcctggaagaaaggcagctcatgagtttgcctaacaggactctcccttggtcactgagggctgagaagtggcactaggaaccaccactgaggcagcctttggaggagccagaattctttggagcaggattgctggtagatttgttagttgtaaggcccacatctcgtcatatgtactatttaataatactgagttgtgactttatttgtggttagaaaaccagctatgggacaaacagtgctggtttgtctctaagcatttaaaatcatttggaaagtgtttgtacttgctgagaggcgggtatattatttttgccaagttcatagtaccatccattggtggtatgaaattaatttctgagcccaccaagtttcaggaagggtcccttgctccatactatgatggtgatgatgtggctgatgatgctgtgctggtgaagaacacagctcagctccctgtggtggaggagggtgttgaattgtcggggaggaagctggagggagcttcttatctctgctctgtgctctcttggtcatgggtccattttcatttctgtagcttctaaggggtccaggctaaaggcataaagttgctttatgctgaacaaactgaccgagcttagcaagtaggatagctctccataagtttaatagggttgggcaatgtatttgaacatagcatgtgtttaattgttttcattgtttggctatatctctctctctatatatatctatatatataaccaaaatacatatgtataaaacaaccatacacacacacacacacacatgaccccccaaaatcaaataggctgatagattactcagaaaaagataagtcacataggaagtgggctatataaaaccagaacttccatgaacacagatgctccctcccactggcacctggcatgcatggcaggtgctttatattgaagtgcagaagtatatgagttttaaatctttaagagactttaatgttttacttgataacaaaagaaacatcacatcctattttcctgaatagtcctttatcttcatatggctcataactgttatagttttgataatcatggcattttggccaaaacactttgccagaaactataatctctacaagtttccttaggctatgaaggtgttttagaggattataattttacatacccctaataccatcgtcggctcttgtttccttatctgcagatgaacgagatgttttctttctctctcttttttctcttctcttctcttcttttcttttctcttctcttctcttctcttctcttctcttctcttctcttctcttctcttctcttctcttctcttctctcctctctctctctcctctctctctctctttcctttctttctttcttttttgaccacatcttgttctgttgcccaggctggagtgcagtggcacaatctcggctcactgcaacctccgcctcccgggttcaagtgattctcctgcctcagcctcctgagtagctgggactgcaggcgcacaccaccatgcctggctaatttttgtatttttagtagagatggggtttcactatgttggccaggatggtctcgatctcctgacctcaacctcgtgatccacccgcctcggccacccaaagcgctgggattacaggtgcgagccactgtgcctggtcaaacagaatatttcctaagggttcatcctgctccacagtctgaggttgttatttgttaattaaataaatatttgttgggcattgaccatgtgccaggcactggggctcaaggggtgcggatgacccatctgtttctctcaggaagctgacatccaggtgcacagggcatagtttacctgtgaacagagagggcgcttttctcccctcagtaagctaccttgcgtcaccttcctctgttcaaagaggactgataaatcacctcactaagcagctgttgcctgcaggtagcccacaccgggctgggtgctgaggcacagaggcacacagggcgctccccacaggaaccaagcccgggaggcacacctgcatgccaggtgctgggggctgggggagtctgtgtcctggtttggttcatgggcatcctggttttatgtagctcacttgctgtgtgacttatctcttcctcagtaatctgcagcacctagatcattcaggttttgttttgttttatatatatgtacattttttggtttatttatgtatataaagtacatacatcaccaaatataaccatattatggctgtatttgcttacatgtatttggttgttttggttatatatgtagagttgaatgtccttttatttccttgtcatatctatttcttatctatagcctgttaagaattcaaagtttttgtcatctctatacaaaatgatggctatttgttgttagtgactatgaatattcggagaaaattatctgcatattgacttgaaatactcttcctaacaaaaatgcttcccctcctgctccacgcttgcccccctaccccgacccctcactgctgctgggctcgcgggtatggtcagcgctgtggcttcgcccgcggcgggccagggaagtgcattagaacacggagcacagggagctatttccttctcgccgcccctggtctgtgcagagctgcctctgagacatttcctgtgcgggaatgaatccagggctccagggctgtttagtctgggcctttgggagttcggtgcagctaatgccttccagaggcccagcccctgcgcctggcgctgccctcctggtgcccacgctggctggctccctgccgtgcatcccggccacgctcacttgcagcggggagtggctgcctgccccaagctggcctgtcatccaggaatgaagatgttctatttgtgttttatatggattcactttgaaactcccattctgtgttcccataaagggcatgcatgtgccgagcccagccttgactccctcctttcgctgtggtgagcttgtttattttcagcgtgattctcagctgagtcgcccgtttcccaataaaaggcagggcccagcactgtgggctccatgagggcctgtttggttgcttggtttggagcacgagggaaaacttgatatgcacgtcatttcccagttccaggcaatgacctggggcagagcgggtggggagcaggtctcccggagccatctggaatatgccgatgagtgagctgtgcattagctctcagaccagggtcctctggcagccaggcctctgagcacagcgtctgaagtatcagccgccacagggatctgtgggcaacagctgcgtgtggcctgtgctgtttctctcctgacaaggaccttgcaaacagcgtggaaatgcgcgagccagcggtcaaacccctcttcaccatgcacggagctcagccgtcctctccctgctcctggaggtcttcctttttctgtgactgtaacctaaaaacattaaaatacgtttattgagatagcaaacttttatcctcttggtgtttgcagtgaaaatagtccttaatggtgtaattttcctttcttacctccctccgcttgtcccgtcctagctcttgttattccaaacagtgtggattattgggctgcacctggccacccaggctggtgttttgaatcagcagcatcacctctccggagcccatagcaggaagcaattgtttgggatctgatactgctgggctctcattttccttgtcttagaaatggggacacatgtctgcccatgttgagctctggcagggatgctggactttttgtcctagctaagaaaccaaactgcatgtgggttacggaagtggtctaagtttcccagtgccagcacgaagcctcgactggtgagtattgtagaagagcactgccttagctgagtccagtatttctcttccaaaataaacgtgcatgttcaaagcaattgcttgtctgtgggtataactgttgtgtgactggtagctgtgggaacacactgagtgtcatgtatgaccttgcgcttgtcttcacgcagatgtcagtaagacttccaaagtctgtgttggtcatccctgggtggtgggatttaagggaaaattttactttcttcttcatgttttctgatctatttaagtttcaataaatgaacatctttttttaactcaaattttaaaaatttgtaacttctagggctttggaatctttttttcttcatggaaatcgaacacagactgagtcatggttcttagaattctgtaattatcaagttgaaaagaaccttaagaattgtctggctcagaacctgggattgagatgagaggctcctgagcctgcacttgcgttttctcctcagactctccttcctgtgctctgcccgttatcaaccgagccgtccctgcctgggttgtctatcgtgtgactgtttcagataaaggcgggttatcttggtttggaagaattcggataaatgacatagttcttcattgcctctccagttgactctgccttacccacaggcagatttaaggctggggttggcacactgcctgcaggctatgtattgtctgtggctgcctaacaacagagctctaacagcagagctggtggctgcggggaaggccacacagaccccgcagcctgcagtggttaccgtctggccctttcatggacccctgctgagactcattagacagtgggatgtgagcaggagacccacggcaaagacagtgaatgtaagatgggaaatccgctgtctggaggggcagtgtctagggggaccagggactgtggtagcctgcctgtggtgtgtgctgtgagctcagtgtcggcccctgaccaaaggcatgcgatggggctggaacactgccgtcgtccttggaattggatgttcagactcagctcttttgctgttgcttcatctggaatgttctcattaggaatgtgaaatccggtgtgggccaattcttatgccctttaaagcagatgtcgggttcaggctgtgggcactgagtcctgagactggcattggtggcggaaagcactgggctcagtccttgattcagagaacacacagcagtgcggtttggtggctgctcccacagtgtccccatagccttccttgcctgtgcagtggccccagtggcttcaggacagcagggctgtgccatagggcagagcctcccaaccagaggctccaggatgttgtggagttcatgaaggtagccatggatgtccctggccattttactgtttcgaagagtaaggtggacatcacagttttatctatgactgggaaacacaggcagagagaaggactaagttgctttgttttggcaagaggggagaggaacagacatgtggggatgcttcctgtgtaccagactgggtgctgggtttttgacttcctttcattttttttctataccatacctcatgcagttggcagccaatactccacagctggggcgtgggtgggaccagagtggtgccctgatcagagtaggcaccaggccacactcacttggctgctgccaggcccagccagggcaacgggcagtcctggaatcaaagcctgtggtctttctacaacaacccatggtgtctggaattccctccattgtggctatggtgttcgtatctaggtggctgaagccttgctatgtttgataaggaacaggaagataaatggttaataaatgtaatatatttggaagatgatattttcaggatagggcacatgcactgaggtgggagattttaacccagcgtctttggaggaaaagttggaaatgatgccttgtgtggctcactcgctggagccctgctggcagacccatgagggcaggggcttagcgtgcaagcttcagggataggatagcaggagcacaggcagtttctttctgcccctctgtcaacatatttcagattctcttttaggcttgtctagcactgatgtcatctaatggggagagtccttgcatttgccttaaatagggtatatttaaagagtgatttatacctttttccaaaacaatatattgcccaactgtcttttggcttccttgagtagcctttatttgagtcgcacagcaaaatcccatatttaaatgattttgagatgctgctaagaagtgcattcatgcctactagtagtcctggtcattatcagtcccactaaaccgggacctagtcctggtccagactagaaattggagtccatcatttcagagtcagtggtgacgtcagtttggtgccatggcctgtggtgcttcctgttttccttgcctggcacttgtacttcatcctttcccctattggcacgctaatctttgcatggttttatcttgatgagatgtctgaggggtttgtatttcatcctgcagcacagaaacaaaggttagctcattgaaaagcaaacgctggtgaattcaggcacacttggaaataaatgcaaactttttggcagtcgtctgtgtaaccaggaagcttcacgagttggcaggtggtttcacatctgtttgttcctttactcaacaagtattaactgagagcaaacaaggatgagctcatggctcccctgaatgagaccagcactgtggctgctcaggtgcaggagctgcaaatctgaaatcttaggttattgctttggctgaaaagtgcaatctcagtggaaaccttatttttaaggatctccagaatcagtaataggacacattttgggttacctcaactaagggacttttctaggtagagtgtacataaaaatgaagtaagtaactttgaacagtgtaattgtaatctattggcttcaaagagagtctagagtaaggagtaattcatcttttaacagctgtaagctgccatgccagtaatagttttttaaacatgtcttttagttttgcatcttaattatttattgggtatgcactaattaatttttttccagggagttctttgaatattttatagtaatactttatttttctggatcacttgtgctgaagcagatcagagagcaagcagaaaagatccacgtggtctaattgatattctgcatgttatatccttgagactctgtcttcactgggggcctagctcctttgggttttggtcagcacactggaaagcctcattctgtccacctgcatttcctgggtgtctgccctttacttggcccagtgctaaatcttgaaaattcaaagggtaataaccaacatacaaccagtgggggaaaagcagacttgtgcaatgattattttgtgattcttgagtcaagtagcaattgtagagtttaataaaatagaaaagggtacagaggaggaagccaattaattgaaaggttatttcattgagggctggaaggaggtgttttgagagaagacagctgagcagcagtgagatactctgagagaacaccatgtgcaatggaatgctgtgtttttaggagcccaatagttgctcacaatttcttgatcaaaaggcataggggccagccatgatggctcatgcctctaatcctaacactttgtggggccaaggtgggaggatcacttcagtccaggggttcaagatcagccttggcaacataatgagaccctatccctacaaaaaattaaaataaaaaattagccaggtgtggtggcacatgcctgtagtcccagcaacccagaaggctgaggcaggagaatcgcttgaacctgggagtttcagatttcagtgagctatgatggtgtcaccgcactctagcctgggtcacagagccagaccctgtctctaaaaaagaaggcataggggcatggaaacaggaatggaggctgttccgctggcagaagttaggctcagccgtgaactttatcttatgtgacacggcattgttgaacagttttcagcccatgatgtgtatttaggggagaaagatcactagctgaaggatagggatgcatttgtcagggtgagactggtggaaaggagattgatcacttgggagatttggcattttaggtgaggtatgatggcctcaagagagccctgcactggggtgagcaggcttttccccagctttgtcagccacctgctgtgtgacctggtggaagttacatttaaatgttccagagtctgagacaataagctctgtttactgggaaagtcactcgtgtggtgctgagattagccatctgcctttatcttttctttacagacacactcagcccagagtcagaataagggggactgtgttttcagatgcaaaaccagggacgatgatagctcctgtgcaggattgtgaagcaggaagattaaatgccaggcctggggctggtgcagagaaggagcccaatgcatggtgattttcttttatatctactaagaaagatacttagggtggtacaagggactgcaactaaccaggctctgccattgtagcatgaataagttggacatgaaatagtctggggcagagattttttagacttggggcctgtgatctgccagagggttcatgcatggacttggcagctccgtgactccttggaactgtgtgtgaagccactatttaacttctctggggagtgtgactgtcacctgctctgggggggggcaccattcctacaaagttagtatcagtggtccagagaaagaacaaggccacagggtgttgaggtgagggtgagggtgaggggagagatgatagtgtctagaccacacagagatcctgcttgtgtagtaatctaaaaactctgaataacttaggacaggtagacttcccaggaaaatgctaagaacccccttcaacttgatcctctagtagatttcagatgtaagaaatattaaagcctattagacaaggcaatttgtttgatttattctggccaactgccagatggcttgtaggtcaagaacaagtaaagttgtttgtttaattcacctttctcctttgaggtaggatttctccattaaactggaagtttctagcaggagtctcatttgatttgccaacatgtttcccaaatcatctaacataatcagaaaattagacctaaacaaagggcctaaatcttttctcccaattgttcaagtatgtttctttgctaaggtataagcaaacaaacaagtctaccctaaaactaaaaatattttctctttctatatccatatcaatctgtgctgctatacaacaaacctaccctttcttagggtaaggaaaaaatatgaggcaccaatgtaccaaacaaaatattttcatatgtatttcatacattgcagagtcatattctataaatttcaggaacttagttgtcaacgtttttatctgcctctttgctttaatttttagagctcttttatgaatgttctctattgcaattcattgagcccccgtgaataatactgcttctgctagaaatgatatatactcagtgtggtggaggaatattggtggtatgctttagtttccttttttttattgttttgtgagctctagatggtctcctgtagcaggtcctccagagatattatacttggatagtttatattctctaactgtatttgtcagagattattcccaacattgctatgttttatttatgtcaactctttaacccaaagcctttggactcaaatacgttatttttcagaaccaaaagagtctgtggtgagacagcaaggcagggcagttggcttatttatggatcatgctcctcttcctgtcctcccaggaattcactttgtcaaagttcttgtgtcgttcacatagatctaattaacatttttaattggtgtgtcgtgtagttctggaaactgcttattagatttcgtaggtgtctctggcagcacaaaatgtttaatgagcaaaataattgtgttacagtgaaatgaatatggacatattcactgaattaataaatgaattaaatgatgacttcatggaaacctcctgagaaagtagttatggaccatcttccctgtgtaagatattcaaattaacttttcgtgtttgtgtgaaggttttgggggaaatactttttttcttataaagtataataatgtgtgtgtgtgtgtgtgtgtgtgtgtgtgtgtatttttaaaccagaatgagagtctgtaagtaaactgagattcacattctttaattgagcctcagaagagtctgtgaaatgtcatggcagctggaaggaaacgagtaggatgtacaatgtccctgaccagagaaatacgtatcttgcagctgcgtggaaattgagataatcaaaattaggttctacttcctgttctgacatgtgatcctttttatcctctgattctggaggtgatggccaagaagtaagaggatatataaagaaaggtagtctgtagattttcagagctgctgacagtgagtccagactcttcctgtattagatgaaaaagcagaacgtgagaggacatgacttgcccagagtggtggctcggagctggggggtatccctgagatctcttaactgctgcccagcccagtgtccttgtctttgtgtgttttctgttgctataatataataccaaagagtgggtaacttataaagaaaacaggtttcatgagctcacagttctggagactgggaagtccaagaacatggtactggcatctgatgatatccttcctgctgtgttgtaatatggtggagggtatcacatggtgagagggcaagaatgtgctagctaaggtctctcttcctgttcttctaaagccacaagtcccatcatgggggccctaccctgatggctttatctaatcctaattacctccaaagaccctgcctcaagatgccatcaacatatgaatttggagattgtgttttcaacacataagatctgggggacacattcaaaccatagccctcttggctaaaccacgctgtctcttacccctcaaagtgctccttatcgcaggaaaatacaggggtcaaaaaagtcactgacgaaagaactagggctattaaacaagacagaggctggatcatttggacccaaaggtgttcttaaaaagactctttgggttgcaagaatcagacccattcaaattacctcaagtggtgggatcttattgtaaggtttgctctctgtggggacccaggcacagctgaacaaatgggcctccatggggttaggaaccacaggagaagtttttttttttttctctagtctgccagtcacacagctgggccctgttctctgtctacttccctctctacctgtgctgccactgaaccactgccctccactggtattccccactagtcagggcttcggcctccttcctttgcccacaatctctgcttctctctgagtccgctgcctttcctgatttggcagatggtattgatgactttttctctgtttcctgattccatttcccaaaagggaccatctcattggctcagggaattacttcacagcaggtacacagaggccattagctagccaatgaactggctcctcaggggtcaggtgacttcccctggcccagtgatatggtttggctctgtatccccacccaaatctcatcttgaattgtactctcataattcccacgtgttgtgggagggacccagtgggagataattgaatcatgggggtggtttctcccatactgttcttgtggtagtaaataagtctcacgagatctgatgattttataaggagaaaccctttttgcttggctctctttgtctgatgtcctccatgtaagatgtgacttgctcctcctttccttccaccaccattgtgaggcttccccagccatgtggaactgtaagtccattaaacctctttattttgtaaattgcccagtctctggtatgtctatcagcagtgtggaaacagactaatatactcagtcagctaagagtgtggtcacaggggcttcaggggctgagtccagggcaagcttacttggaagggaccaccccatgcagagagctctgcagtgggatttatcagcagatttctccatgcaatatgtttaccctgatgcaagcttcctcagattgataacattccaatcctacttaccaattttccccttcttgacaaagtcctttgatggccagcccgctgtgcacacacagtactcacagaccctccgtcagcatgagcatgtggaggtggtgaggagaagtgatggctcaggaaggtccttccagctcgtctgtgtttggtgttggacttctgtgtcagagtttttcaaataaacctgttatttgggaatgatcttaggtttatggaaaagttgagaaaacagaacagaggattcctgtataccccttgcccagtctccactaatgttgatatcttatgctaccatggtacatttgtcaaaactaagcaattaacatgggtacattactgttcactaaattacaggttttaccagggtttcagcagtcttgccactcacgtcttttttctgttccaggatccagtctagaatggcatgttgcatctggcgctgtaagggtttgtgtgaagaaaggattccactggtgtaacacacacacacacgcacactaacaaacacagcagaaaagtacccaaaagtttctttatcctctggtccatgccacactcctactttcaccagattcctctttattaaaagttatgtttttaccttcccctccagcataaggacctgcagtagatgcctgttgccgaacacaccaaatccaaatttccctcccggccacagggggttcctattctctgagtctactctcctgcctcctctttcttctccagccatggtagtggatgctaggttccatctgtctccctgcctttttcttgacatctctgagcatacttcatccatgccacattctaagaccatttttccatgacctacaccttttttttccatcctggcaggaattaggtttatgtgttagtatattctctggttttccttttaggctttactgtagttatattgccatggctgtaagggccttgaatgagcaaccaaaggccagtttggtgatgtttgctcattgctcaggggaggaggagcctgattttgaacttcaaaaaaattatctatgtgataaacatatgtatgccgtaaacctgaataatttttgaaaagtaggtaattgcttcacctgttgaagcatgaagaggtttgtcttacttagttttctgctgctatagaagaataccacaaactggataacttataaacaatagaagtgtatttgactcatgattttgaaggctgggaagtccaagagcatggcgctggcatttggtgagagtcatcccatggcagaaggcatcgcatggtgagatagtatgtgtgcatgtgagagaatggggctgaagtccctgcttttataactagcccactcccatgacaatggcattaacccacttaggaaggtgaagccctcatgacctaatcacctcttaaaggtccaaaccctctgcattagggatcaaatttccaacacataaactttgggggacacactcaaactatagtgtcccagaaaggtgtctgcatagtataatctcacatagtcaggtgtttttcttcctggatgtgcttgggacatagaaagcacatggaacttgcacaggagatattttgcattaattgcaagaatgaatcgatgttgcgtaaattggtgactaaaggaatgaatgagtgggtaagtaatggctccagttacattgtaatgctttgaggctaggctggtatttccttgatatcaactactgcagtggtctacatataaagtaattctcaatttaaatgatttcttatttttaattttaaaattaaagtgtcaggccaacttggatatttgaatttctaggaaatagaatgctcaactgcctgtttctaatatatagtttatttccatatgcatattgccatataaaattatactgtttttcactctcatatttcataaaataacttaaacgtttcccatgaatctttgacattggtgtcttcatcatcacaggaccccattttgggtctcctaacaggtttcagagctcatcatccttccacatgactgtgtcgtgagatgtattttctagtcgtttttatcccaagccacaatgactaatttattcagcactaaaaattaactttttaaaagaaatctttagaagattgtgtacaaaactgtccagcactgtccaaaactgacccagaattgtgggtcattccttctgggttaattactgaatctgtgttaacttgccttcttgtatactgattctcaaaaagcacatcctgagatgactatcagttgagttagtttcaggcttgtgtattttctccatatactgctttcgtgttcttaataaagtaactgataagtgctttgcaaggtgagagtctacacagggaaccaaagagatggtgaactctcccttgctgctgggtgattttggaaacaaagctctaccttatatctagatgcatatagtagttcaactcccacacagtaaagatctggaaattgaagcctggagagggagaggtttcagtggccttttgaaggctgtgccttttgtgtataaaccaggactagaacatttgagtcttaccccagctcttcacaattcagccttaacttttatttttgagataaaaaaaatgagaaattaacttcttttatcctgcccgtccactcactctttgattctgaaaatgtacagttcatccctgaaaacaaaaacaaaactgatgagtctctcagcactttcctacatggagcatttgatcctcccagcagctcggtcaggtcaggaattatttatactctttacatataaggaggtaaggccaagggggttaagttacctgtccaggggcccctgccaggccactgtgttgtccctgggccattctctctagggcattgtcccaaggaaagtgggctctagaatcccagagacctgtgcccccacacctaccagttgcaggtgagtgccccagctcctcagagcctcagttattctcttctgtagaatggagccctgtggtccttagtggggttgagtgacacggtgtgtgttgagtgctaggtgctgtccagggtatcacgatctctctgtgaacgtggggtgttgagcccatgtggtggttccatgtgcttcgtagtctcctgcatgtgcttcaaggcactgccccagttgccttggctggccctgtgatgcttgggtaaatccatatctcctcccaggtggtctgaatttctacactcccttgggagttctgggagcttcttggataggtgactggtcaaagcagtgttcaactctgttccttctcccttacttcaaatgaccaagttcatatccttgttcataaaaataagacgtttatcgcacaaaggccaggagtttcctagcaggatgaaatgcagaaaggcagcttttcaggtgatgaaagcagatatgtcagatgtggtctttgctattgctgtggcggggccctgggggagctctggtcccctgtctgtcccagccgtgggtctgctcactgctcagagtcctgtgcggatagagctgggctgggaggctgagctgttgcttagctttgagcccctctgatccaggttgttggcttcccccatccagtgctggggtgctcctgtgcctccatgggcttcccagagagtgagctggtcccaccagaggtcccagcccacactgggctgcctgcttccccctgccaccaggaagcagcctctccaagtgcctcctgtgaatgtgcagcctcctattctgccagaactttctggttgggtttgcagagttcagggagttgtgccacatacaagaaagtatttgccaagcccaatgaggcagttacgtggttgtccagaaaactgagcaaagacagtttgtcattgaagctggtccctcagcgaaaaaggcctcatcaaacaaccaagaatgtaagaaaatatatacattttccatttatttccacctgaaaaatatgaaaagaattgtaggtgtctgtgaatatacccatattgtagcaccacctacctgattaaaatatggaacctgcttattatctgtttgtgtatttcgattccctttgttggggctgttacaccgtggagatagtaaaatgtgattagagtggaatatattcatttgtagacagtttggattgcatctgagatattttcctgattgttagaatttctctcccattgggatttaaagggtggttatttttccgtatatttatcaagtggaagaataatttgacagggacatgttatcaggtaaggcatctttcctaatcgatgtgaataaaatcccatgtaagaggagctcagtgtgtttgcatatttttttaaacaataaaagattggattgttagagcatcagagaagagtgaagacagctgtgctttttatcacagggaacctaaagaaaaattcttactttaaatccttgatccgaagaggcaagttaatttaacaaaataaactcaggacatcacatttacttgagtcacagagcatgttgaaaggtgcagacatcacagggcatcaaaggatttcacagaatgctgggggtggagtctctgtctctttggccaggcgttggttttcctgcctttggggttggcagagaagccggagccaagtccctggacaggacagccctcagacactcctggttcaccttagttcactaggcacatggctcttggtggaaaagacgatttctggaaaggaagtgggagactttagacagacaaaactcatccaggattttatattgtgatttcaaattaacttggcacactaatacttcagttattaatcttctgtggcactgtaggagaaatgaggcgacagtgtcttgtaattaggggcattcttgtgcctgtcaaaggggccaagtcgggtggtgtggatgcatcctcccccagctcctgggacggctggccctgtgccctgtgccccgtgcttggccagcagaggcctggccttggctgtcacgagcacatttcataccattctctgggccgtttttattcccttagtcactgggatcctgttttgtatttaacccagtgtcttgacttgtgttgtacattcccagggtgattttaacttcaggagagggcaggccctgtctctgtgtccttgaaatgctccttttaataattttcccagcatttgaaaatgtcattactgagatttctgtttttgcctcactgaaaagaagacgaagtgaactggagtgcttcccgtgtacgagatgctttcctttgcatttgcccagatgaattcatgtaatcctgactgcagccctagtggcaggtactgccattatccccatcctgcagatgaaaatgctgaggcacggagaagttgagtatcttgtgtgaggtcacatagcattaagaggcggagcctcgatacgaacctggggagtgaggctttagagtgcaaacacttcaccgccgtgctggaccacccgtgggagttcaaggtgtgtgtaaaatgaaagcatgtagggccagttacccagaccttgatttagaaagtcaattctgtttttgacatttccagcaaccagtaaagcaaacaaataacctcctgcccccagtttattaaaaaacagctcctgttggaatggggttttgggttgggatggagccccctaggaagaccctgcgggaaatgcatcttactagcttttctcaaaggagccacacacacagctttgaggtaaccatttttcttggggtactctgaggactgggcagcatgtgggaatgcagaggctccagtgaatatcactgccttaggttccacctacaaccccagcaccagcctcacctccccagctatggggtcagagttcagtttcattttcagtaaatgtgtgattctgtgggtccatatattcacccagtttatagcaaaaaagcgtgctagaactaattggaagtgtagaagccatgatgctgcctccccaacctgtgcccctagaagtttgctcgtctcccagaggcggagctgggcctagccctggcaccccaccccataggtgctggccccacctgtcacggatcatttaagcatattttgctagcatcatgaccacactctttgctggctccagagccacagggtgagggacacaggactctgtccccacggtgctgaccacttcgtcgtcattacaagaaagtattcccaaaggcatcggtttacttgttatcttaggttgagttttaaaatctacttgaaattcctataattgcacaatttaaaaaactcttcgatctgatgtgacctgtttagtcttttctgtttagtctgaattaggaaagctcttttctccagagtgcaaaagacaaccacagactttttttttttaaaggtattatttagaaaaagctaagatggtgcttaaggccgcacacacgtaaatacagtcatgtactgcatgaagacgttgctgttgttgacaattgcatatactgtgtgataagattatatctttactgtaccttccttgtgtttagatacaaacatttaccattgtgttccagctcctaaggtgtctagtacagtccatgctgcacagctttataggctaggagcataggctgtgccacatagcctaggtatgtcttaggctatgccatctggagttatgcatgtacactctgatgttcacacaatgatgtcacccaaggactcatttttcagaatatattctccttgttaagtggtgcatgactgtgtatatatgtctgtatgtccacacacaggcacacaggtgggcttgcttccgacttccctctgacaccatcctctgccattgtgaccaggaccccattctcagcttatcagcacggactgggtgctctcttcctgccgccgtcaccgtgggtgttaagcctgcctgtgttgtgcctgtcaggactctcaggaacccctcagagcagcccgtctttggagggcggtagggattgtaaggaaggggggcacagcgggggttgcctctgctccatctcacctgcttgggtggagtctgcaccggcttgcagcccaccccgtgagcgtagtgagtggtcccgaactgcagatgtgtgctctgtgcggtgctctcggacatctaatgagcatgggaaacaaaatatgacttacagcagtgtattgacttcccaagaaccagaccttgctccctgggcccgaagggctttcctgctgcagctttgccatgtagcaggggtgcctctgaaaactccaccgccaccccagcagacaactgtgccagtctttctgtgggatctgggacacagaaaatggaagctgtctggcctggagcgtggtctcttggtcctgtcttcctcacagtgatcaccacctccagggttgcatgggaggctgctgctcagcggggtctgggaccccatgggcccagccatccacacaacaggtgtggatgaagcatgcgcattgtttccccctggggtttgtgttgtccctgggtttggctcttggtctggatgaaagagaccacgttcagagaagcggcatcccccgtcattgtgactgcatccctatggaggggcaggggtcccgtcccctctccggcagcagtttgcctatggtgagggtgcagtcatccacctgggctgcatgccgagggctggaatgcaaagcgcttgggtttgctcctgactttgcaagaccacctcccaccacgtggtgcttgccgtcagtgtgtgctttgagactctgagagacaccatcgcagaagccaagcgttacactttggttatttattgacatccatgaacagattaaaaactgttcctactttctagggtgcttctctctgtgcagttgccagggggaacgtgttcgctttgccggggcattgtgtagcagctggcatttagtctcacaactttttctttgtttaattaaaaaaaaaacctgaaaatgtttgtgaagtactcttttcatcttgtgaaatggaagctgcttctgagggaagcaggcagcctctgtcttcaccagccccttccaccctcccataggagtccctccagtggaaacccactcactccccctgaagccactctctgagagagatgcctccactgccttgctagcagaggcttccccaggctgtgacctcgctgacagtgttgtgtttcttcggggatggaaaatgctgcttctgatacccccgagatagaggaggctctggtgtgttcagaaggaggtggcgtgaggtctggccaagcttgatctggagttacctggccttggcattctgattgtcaggctccacctgacaccccccaccatctaccaggcagacaggagaggaacttacgtgttcagtcgtttgacttttttttttttttcttttttttgagacggagtctctgtcgcccaggctggagtgcaatagcgctatctcggctcactgcaacctctgcctcctgggttcaagcaattcttttgcctcaacctcccgagtagctgggattacaggcacacaccaccacgcccagctaatttttgtatttttagtagaagcggggtttcactatattggaaaggctggttttgaactcctgacctcatgatcttccctccttggcctcccaaagtgagtccatattctctgttttaaaaatttaccccctatcaatttaatgtattgtgtaataatcaaagttgaatgtaaaagcccattaaaaatagcttttaggtttgcatcattatctgcactgtctggagcttcaagcagatcttttacaagttccccaacagtgagacccacttctcaacactggtcagagttctcaagccgacagtggccagagatcatggtttaagcacatccagtggttggcataaggttggagcgatcatactttctgcacttgattgcctaatggatgcctccatgaggttggatgcaaactctgtgtggaatgttcccctggtgtttctctaacagatctgctcgtggtttatcatggaagaagtctacagaactaaaaaggagaggaaacttccaagtgctctttgatgttgtaattgtcgttgctttaaacttttcccgtgatcatatgggatgattctgtgtaggtgaatattaacaaacactgtgataagaatctttccctctattacaatcaccttgacatcctatttttttttttttgagacggagtctcactcttattgcccaggctggagtgcagtggcgtgatcttggcccactgcaacctccgcctcgcgggttcaagtgattcttctgcctcaacctcctgagtagctgggattacaggcatctgccaccacgcctggctaatttttgtacttgtagtagagatggggtttcgccatgttggccaggctggtctcaaattcctgacctcaggcgatccacccgcctcggccacccaaagtgctggggttataggcgtgagccactgcgcctggtcgacatcctatttttatagattgtttccgatgggttgtaatcttccaaaatgttgattgtgtttcctgtggaattgtataacacctgagtgaacagattgttaatgaagatgggtaaattaccacactcccattgcaactaattatattgcagcgacttggtgaaaatctttcttattgtttcatttctacagtctatgtgcatttaaaatcacctgctgatggtcttcaaaaaaatttgctaggtgttgggtgtctcccttcttttcccagtcacatgactcacacccatagaatgggatcactcataggtgttgcatagacccaggctcaaattaatcatttttaaggagtgttcaattcagaaaacatctggttaagcacttactgtatgtaaagcactgtgctctacctaatcagaaaatatgaagagtattgtgatactttgcctactagatgccaatatttttatgggggagataattctaattcattttaatagttgcgtcaggcgaggagttagcacattgtttctgtaaagggccagagagtaaatatttcaggcttcttgggccacaaagagtctaacctcctctgttgtattcggaaagtagctgtagacagcatatcaagtgattggagagagatccagagggacagattgccaatgagagtagagggtccccaacgtgctatcaaccgggtaggaggaaggatgcagtgatgccactgggatgggtgacacctaggacatgtgcttaaaaaagtggacgggaaggttgtttctgacatcaagaggaaagggagttgttgcaaatggaaagtaagtgtgcaatgccctggagaatcattaggagctccgtgaggaccctggaggggccttgcagtaccagcggaggtgctggtcagcttagtctcttgcatacctactgtgaatactatttagaagaaagtggggtgagttataaatcaatgtgtttgggtgcggccaggctgtattgttgagtgattcatcttccatcctcattctcacagcctgggaaaggggtagggtgcccctcctgagagtctgctcaggcttgacgctgcctcccacattatgtgacttgaggggcaggcatttcccaccctttcacatgaagaaagtggaattgcagcaagagcagtcccaataattggagccacttgcccatggcagtatagctgggtggtgtgacagtgaggaccagtgcgtttctccttgaggtgctgatgcgaggggaagccctgagccaggctccagcagtcacagggatcacagtcacagtcacctgttgggcaaagtccccaggttgggactgaggattcctcttctttgtggttataaaaacaataaccctttaaggtcactgagaccagcatttttgaaacctttactattattattttcaacagaagacccttctgcttaacaaaaacagttgaaagtggtgcttctcggattgacaaaaagggcctcacactccagcccctacaaaccctccccctccacctcaacccctgcagtcattttggcgaacacaatttgaaaagcattgaatttgtctacctgcaccttcactttgcaaaccgagcgacagaagtcaactttggttaattttggactcagagttcttcacggtacccaatattggttctttgagagcggttcggttctacatatggcactaactcgtccactccacaggctactgaacctctttatgattctgtctgtatctaagcagggaacctgtccctggcactgcagctcatgggatgtttggagaaatcgtggcttattggaaagtgatctgagatgcttggatacaaaaagcagaaaatgagtttttaaaaacctcttcttttgagcaggcatcattctcaaaatgtggagtatttatagcatatgttactcatagaagacattaacttcccaattattaagaggaaatgcacttttattattagaaatttaatttgtattagcctggtatacatttgtgttggatcagagtaagcctttcttatagagatttggtaatttctatgcctgtgccagcgtggtcctcatgtggaatttctgtcttgaaacggcatggaatagtctatgagataaagagagaagctggaagtaaatatacagaaggtaatgcaaataggccttccaactgcagaggaagactcttatagatgactgcatttttcaaggacttaaattttaaaatctggaaacttatttcagtccctggggcttccagtgcagccacccatggaagtcacagcagtgacagacgagttcagactttgacaaatatgaatggtcattgggatggctttgattcaccatacatttctcctgcacctgtttctgtgcactgattttatgaattttcaatttatgacattccagtgatatgccagttactatcatcatagctgtggttaaattaagggtgttttgcaagaagaagaggtattgtgatgaacctcttgtgacttggaaacctgcaagttggaaaagttgtaatacagatccatcaacagatgtcaatgtgccaagaaattacttagtgtggttcaaaggtgagtaaatagaagttaaaattatgaaggaacattcttaactcacagcagttggattttgaatcccagaggaaaggccagaggtctcacattttaagagaactggaatcagggcaaattgtctgcccttcctgggaagatcagctgagtgagtgagagagaaataggttcctgtcatttagccagcatttacatttttttcttttaaggctttattgagacagaattcacataccgtgaattcatccattcaaagtgtacaattcagtggttttagtatattcaacatataatgtgtagccatcgccacagtcaatcatagaccatttttatcacttctaaagaaactgttctccttactgtcaccccagctctgggcaactctgtgggtctccctattctgggcttttcatatgaatggaatcatacagtttgcggcctttttatatctggcttctttcattccccatgatgtttctgaagctcacccatgtggtatgtgccattcatttttttaatgctgcatagtattctgttgtatggatgcaccacatttctttctccattcatgagttgatggacatttgagttgtttctacctctacatttaatgatggtctagaaagatcagtatgtagtatacattctgaccccaaatcattatttttctcacaattaaagggagggcaattaaagggaaaagaacatttgtgcagtgcttagtgccttagaaagggtgttttctacccagcacctgatttaagtctcgtctagccccggggatgggttttctgataatctccgtttacagggtttggcaggctgcaagccttgccccaggtctcctggcagggaaaaagtgaggtcagttggaatccagctgccatgctccttctggggcaccagagtgagtgactgactgctgaaaataaacttttgaaagttttagaacagtctgttctgcctgtgtgtgtgcacagtgtgccaaatctccaggtcaggatattctgataaaaactccccaagacgctggatgcatgggcagttgctgttgatggagtcactgtctcacatgtgtccaagcccttcccagcactggttggaatccctgaaacaggcacaggcactgcccgtgcagaccacgtttcaggaacttagcatccatcagcctcatgacacaggtggattcgtaacacagatgccggtcttgtgtttcttacctgcaggggactttcgaaagcttgggctgcggtgtccccagctgtgccctgttcccctgatctgtgtgtctgctgccacccctgcttcccagtgggctgggcctcaacccctgccatccacagtcttcagctgcgctctcggctggctgatggcagctgtgttgaggctctgtagaatggagaagtcctctgacaggtgggtggtgcgcatctgaggaggaggggcatttgctccagcagcactgaagggcgaggagcacccccactttcagggcccggcgggcgggctgggtagggagggcaggcacatatgcacacacaggcactttgtatcttctgcatatacaggaagagatgggtttggtgatcagcagagcttaggtttcatcagggcaggtgctgagcttcattccctccaccctaaacactgccctgcaggccggggatgcttccaatcctgaatgctcaagctctgcccagaatgtggttgtcagggcaaccaaaattcacaggacgaaaagattgagaagcttacagtgcttgacatgccatatagagaacccttagcttgctacaaactcagtttttaaaaatgctacttggaaaagaaaaaagaaaaagaaaaaaatccaaggaagggagaaagtagaggagctggggagggaaccccaactccaggatccttttttgtggattttgagaacacacagctttttagaagtgggggaaatgaaaatggaaggggaagatggtgtttaaaaggaatcctaataccctggttctttgactgaaaagaagagcattttacacctatatttgtagctggcagatggataaaaactaataggaaaaaaaggacaatttggttctctctgaagtaataagctcattggagatggggctaggagagtgataggactaggactaggactaggactgcctacactaggactgcagtccatgggaacagggagctaacaggagggtcccatagctagggtcatgtggcaggcagttcctgggaggaaggaggggtgacagccaggacaaggggcaagtgaggagctgctgccaagcttccctgccctctgggaccaggcaggccctggcctgcggacaccagcgtctgccactcatgcctgagtgtcaactgtcgagtgtccccaccccttcttggccttgccacataaagagctgtaggctttattttggaaacctacgttctttagaggcctgcttaattaagtttcccatttgcacctaaccctcgcatgcttgatgggcttcccttgctggagctatttttgcatcgttttctggaaggatgcctctttccccgcaggcagcctctgaccgtgtgccagagagctccgcgtttgcatcttatttttctgagcacttgctatttttattttttttggtactcatttgacctggacttctgataaggcgtttaaaaatagcctttggacttcctgtgggtaattgggcttctcagaatctcccctctacttttaaatacctgctgatttgtgtcgcctgatcccggcatggagtctggctatgcgtttggaaggtctctcgaatttcccttccacctctcagggttgcattatctcattactgactgagcacctcgccctgcagcgagaagggccaggtaccttgcgggccttctggagacaccaccagaaactcccatttgcagtagcaaatctgtacgcacacctgtttttccaaagtgggaatccaggtgatgtcgaagggctccagagggaacgcagaccacctggctctaagcctcctttaatgggacgagggacagaagccggcaggcacacgtcccactcagggtcacatggctggttggccatggcagagctgcagcctggaggccttgtccacccttgaggccatgtcggggtgtttgggacggcagagactgcccaccctcctgcatccgctgctctcctgggcccctgggctgctccaggccagcagccctggattggtgtagctcccctggccccaaggcctggcgttgggctgtggcttgcaggcctggctcggtcctaccactggtccttctatcatttaatcccgtggcgggcagcctcctgctgtggcatggcttccacagcccttcctccatcctgggcagccctgcaagggaggacacaggtgactcccttccagtctgtttctagagtgtctgggaccagctacttagcacctgtgctgagaggtccgtgggtttgtcgtcctgcaagagtggccctacatcatgtggctggatgtggagttggccttgaaactccgagtgctgctgcgctgtggttgcggctgtacctggcctggctggctgaggtctggttgcagtgaggggctggctctgtgaatcctgagctggtgtgtgcctcctcccggaggagggagctgcaccacatgccccgtggccttctgggcctacttgtggccaaatgagatcaggcgccaatagcatacggtctgactgctgactctttggggcacaactcacagggagatcctgccaagagacagaggtgggcctagatggacttcctttgaggaccccggcacatcatagaggctggcactacttgctgagtagtgcgaaggcttcccctacacagtgcgcccctgtgctgggcactgggaacaggtgcttagtttgatttcccttagccctcaccatagccctgtgagtgggtgccactgttttcccttttctgcagatgagtacactgaggcacagagaggtggaagaactggcccaaggcaacacagctagtagaggcagaggttgggtttgaacctgtgcagatggctcctgagctcctgctgcagccctgcggcccaggaaggcggtagtcttgttgcccttcctgccaactcactgcagaatctcagggaccaggtcagggggctgccagggtaattcgttggtcgttagggatgctgggatgcacttggcctcattctgggagggctgctgttctgcctgacacaggaggggttaagaagggaagggaagggccagacccacttggacttcagtctttcctctgccacttgcaagctgtttgtcctcgggctggtggcttaatttctcttatcttgtttcttcatcagtaaatgggggtgaggctctccccaaccccagcaaatgagaccctatttgtgaaggctactcaggagtcagatgcccatattcccacagccacccttgatgcaggtggccggggaggggtgggaggcccttttagggggacctgtgcttggggtttaatgctctgcagttgctgttttgagattcttggatatttacctttgcatttgtgttttgtgagatgtgttgggacagtaagcctgccagggcccagtagggccgggtgtgtgccttgctggagtagaagggtggccctggcccctatcaggctctgcactggccctgcctgaggaagcctggcatgaaatagcaaattaaaaaaatgctatggtgggttggggaggaactccaggagaaaggaaaaagccttacttttgctttttgcacagaagactgcacttgccttttgcatcaaatcccacagagtatgtagctggccccttgggcagccttggttatttggcatctgggtgaggcccaggaggtcagaggggttgaggtttttcacagagttgacctgtagttaagtaagcggcaggtttccagcagagttgtggctaagcccagtccccatgcagtgtgtcagttgggggtgctcgggagtgtggagcctgctgtgacatttgaagtctctcagtaccctaagcagaacacttagaagtcctgcccagtgcagggatggccacagcagggaccttctggaaccctcaagacatggcctgcataggttgtaaatcgaagcaaaccagccagccagcctgtgatctaagccctgtgagatcacagctgcagtgtcatctctaaatgacaggaatttatgaccctgaggaataaattatcaacagtgcaagacaggatcacttcaaacatccttgtgacaacttaaacaaaactcagtgagcaaggggtgtgtgcgagaggtagaggggcacagtgggctacctcttgggtaccctgcccagcacagattggaggatgatagctgtctgagtttctcaggctgctataacaaaataccacacactgtgtggcttaaacagcagacatcgatttctgtgagatgtttgtttctcatagtcctggaggtgggaagttcaaggtcaagcttccagcaggtctcattcccagtgagggctgtctccctggtttgtagacagccagtgtcttgctcctcacatggtggagacagagaacatttttcgtgtctcttaaaaggggactaatcccattcgtgaaggttccaccctcatgacctaatcaccttcccaaaggcctcacctcctgataccaaacctaggaagtacagcctttgacatacctaggctacgtggcacagcctgtgttccccggctgcagacctgtgcaggatgtgactatactgaacaccgtaggcagttgagacatagtggcaaatgtttgcgtagctaaatgcagaaaaggtacagtaaaaatacagtcttatgggaccccatggtatatgcagtcatcatggactgcaggtcttcacgtggtgtgtgactgtatttacatggtggccttaagcaccgtcttgagtttttctacacagttccacttaaaaaatggtcttgggggtccaggcatggtggttcatgcctgtaatcccagcactttgggaggctgaggcgggtggatcacaaggtcaggagatcgagaccatcctggctaacacggtgaaaccctgtctgtacgaaaaatacaaaaaattagccaggcgtggtggcgggtgcctgtagtcccagctacgggaggtgcttgcagtgagccgagatcatgccactgcactccagcctgggtgacagagtgagactccatctcaaaaagtaaaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggatggaatggaatgggatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaaataacaaaattgtcttggggattagggcttagatgtagaaagcttaagtgtacacaaccttcagtctatagcacccgctgtacagcacgtgtccccagggacgtttgcagtgtctggggacagttttggttgtcacagctaaggtggggtgggtgctgctgagcatgctgtgatgcatgggacagccccccacagagaaatgtcaccagtggccagggtaagaaaccagcattttccttccaagccctagtgatgtggaggaaatgttacggacatgctccacatgctcctaaggtgactttgttggtatggaatatttctagtttacaagagaacagaataagaaactccagaacaccccatctgcagagtcgccagaggggccctatcctgcacctgtagttggggctttcagcaaggtgttctcagtgggcgtctgtttgctcagaggccttcccagaccctgccgcagaactcactagcagcctcctttccataggctccttcgtggggttgcctgtggttttctgtcatctgccttgtctttctctctttccctccatctctgatggcttctgtgtcctgtgtggtccctgggtatggctgtgaccttcatttcctttgtagtcccctgtgtcctgctcagtcggcgggtccaagcctccgactctgccctgtgtgcagagcctccaggctcccggcctccagccttgctcttctaggcaccgccgaccttttccacctggagatgccacagcctcttaaagtgagcttgtcccagcagcctgccccacccctacctggccaagctggaggcctcttttctcctggtgtccctgcactccggttggttcacctgctcacaggctctatttcttgctgcccctcctcacccctcatgcccactccatgaccaggtcctttagggccggctgagcacagaagaaaaacacagggccctgagttcacaggacaagagaaaagcttttcccctaagtgcggcctctcagcctgtcatggggtttcctatgtgctgtttcatgtcactcctccttgggccctgggtgctgttgggatagtgcagacctcgcagtggcccggggcccacccacactggcacccgggctgctgctggggacaaaggggcagcagcagcagctaagtggctgtggggacctgggtgggaccctgtgagctggagctccaggctgaagcagccgtgctcagggactctcagttctctcccctgtccctcagcacagaccttattttatatcaggtacggctctggcttcacacgtcttccttccggcggcctctgcatggctgcaagatgcacggtcctgaaatgatgctttagttttgcctcttctgcacttaaaaactcattttgcaaagtgaaaattttgctggccttgtatttgaagcctttcacagacagaccccagccccactctcccacaggcctccctgatctgtgacctagaacccacaggtacatggcctgggctttgggccttggccccttgcctgtgtgcaggctgtttcccggatctctctgtctccaggcacacatccaggtatctcagccgccacaggccagcagtcccacctctctctctcttatctctctctccccctggctaccccaggccacccttgctgtctcctgctagggtctcccctccctggtttggaagttgctctcctcctctttcagttttgaggtctctgaaagtgtgatctgggaccatgccgggcctctcacagcatggccttcgtttgggacgtttgtgtcaggaggcaagtgtctgcccacttctccagcccgtcagcagcatgggaaacgctgcgccttgcatggagagccacgtacagcccaggggcacagccaagcggtgaaaggagcattggtaggaaatgagctttgggaagtgggtataaatgctgctcagctgatctcttgggttatttaaatggggcatagtgccctccctccagggagaattatgtcctgtgttgctaagcctcctaccaatgagtctgacacatctgaaatcaatacaaggacccgtggcatcataaaaaaactggtggagaagcaaatgttttaattaaagtaacctgtaatatgtccaaaggaaacgggacacaggcacagaacctaggccacattgtatttgccttggagcctggctgggtctcgtgacagcacagctggcaggaggcacacagcctcccctcgaggcgatctcggccactttctcatcttgacagatcagcatatggacgcacttacagcttgtagatgaacacggggaagaaaacaacccttctcttccctcccttgtttcccaagccacctgtggactgcagagtgaggatgcggcccccaccttgcctccagtgctgcctcccaggtccatctcggcagcgtctggaccccctcggaggggagcgatggataatgaaactccctaggagtgtgtctcggctgctttgggctttccactctctgtttgagattttgtgaagggacacctaattgcccgaacttaattgtactttttagtacaattactaaatgtagtacaattacaattacacagtactttttctctttgtccctggggcgcgttcttgttcctcacatgtctgggtagctggtgggtggtcagcatggctgctttctccttcccctcccagcagtcagcagtgattattctttaaaaattgagaattcctttttcagagcatagagggtgaggcgtcagcccggccccaggaacctgggtcctgggaaaacagccagcacacagccttgggtgagcaccttctctccctgagcctcagtttccccatctggaaacgccacggccttcccgtggggctgtcgacagcccttcccatactatggagctcttaggatcatacacacatttaagcaaagggggtcgagagccccattcccgggaaagggcccaactttaagtgttgcagaatttatggactgaacaactgcttggctgattagcacagttttgtcccgatagtaatgttttagagtgtaggtgtcatggaaggaatgcaaacacaatgggagctggtcttgtgcctgaggataacacttgtgcctaacaaggtaacacttgggcctgaggatactggcctggccatggtcctacagtgattggaggggaagaggctccaaaggctacagaagctccgtcgagcctggaacactggtggccctgcacggtgccctgggcctgtccgtgtcctcagcagtcaaggagcactgtccactcattgagtgacatcctcattgaggatgccttgcccgcaagaaggaccctgcagagagccaggagcctcttcagagagccccagggcagcatcaggatgaggcaggctgtgtggctgtaattaagaggctacaggtggctctctcaggtggacgcagcagacagtggcgcagatgcggcggagcttgctagtccttatgctgccctgttgtgagacggatggccttgggagggtgtttccgcgtccctacgagcgcatcacctgtggtcaggcgatcactgtatccctggccatgacatattctttaagtcgcttcttagttcctaagtcccaccgctccccattgcctcctgaatgcagttgctctgatcccagggcatgcatttggagccctctgggactgctccatgtggttcgtccagctctctggaacactgttctccactttccctttgcacgacaagcatcgtggccctgtctctgtgcaccccatgtgagtgtcctggccctgtgtctctgtgcaccctgcacttccaccccctgggcctggagccccatcttctctccatgggtatgctctgcccagcccacagaacccacatacctttcacaccctcggtccatccattcctgccctttgtctcatgcacgcctcgactctgaagcgtttgctctcttgtgtgggtgcctcgctacctacccctgggcccttcttgttccctgtgcggcctggcagcccttgatggcagggctgatgtgtgtgctgttgtggccccaaggcctcccagcagagcatctgcacggtgctccagtgtgaagcatttgtgggcttgaaggggctctgagtgtgaaaacccgagtagtttatatctttgagacgtcaggaggccattcgaaaaatgcctggatttgcacctcctgcccactggctgtcatgaacagtctcagacaaggcgaagagggtaaggagaatccagtgaaggtctgtctcttctccatttagattcagccattaactctgccacatctgctctttccttttatctgtctgtatgtctgtctgtctgtcttgggtgaaccatgaaacttactttgcttatgccctgttgcttcattcctagataatttagcagacacctctgcagaataagggcactcttctgtgatcctgttatctcacctaagagagttagcaggaatctccttatcttatcttttaaatcattatcaataccagttcacattcaggttttcctgattgtcccttaaaaatctgctgtagtttttgttaaaactgggttcacttgtggcttttgttatgcccctccaatctcccttattctagactagtttctcaacattgtacatatatttgtgtgcaatgtacaatgtacacataaatgggtgtgttcagcagcgtccctggcctccatcctccaggtgccggcagcgccacctactccaccaccaggtgtgacaacccacacattgccagggacctgctggcaggcaggatgccccattggagaactgttctagcagtctcttactttgcttttgaaggtattgaccctttgaagagaccaagccaattattttgtcaaatgtcctgcattctagatttattgggtcatttcttgatggtgccattgaacttgtttcttgattccctgtattttctgtagcgtggaagtgggggctaaactaaaggcttttttgtgttccagggaaataattttagaagtctgccttttaaagtagagcaactgggtgggcatggtggctcatgcctgtaatccttgtgctccaggaggctgaggcaggaggatcacttgaagccaggaggttgagaccggcctggtcaacatagtgataccctgtctctacaaaactaaaaatattaactgggcatagaagtacatgcctgtagtctcagctacttgggaggccgaggtaggaggatgccttgaatacaagagattgaggctacaatgagccatgtttatgccgctgcactccagcctgggcagcagagtgaaactccgtctctaaaaataaataaataataaaataagataaaaaaaattagagcaacttatgtgacttttttttttttttttttaaactgagtcttgccatgtcgtccaggctggagtgcagtggctcaatctcagctcaagagattctcctgccgcagccttctgagtagctgggactacaggcatgcatcaccatgcctagataattttttgtttttgttttttgtatttttagtagagacagggtttcaccatgttggccaggctggtcttgaactcctgacctcaagtgatccacctgcatccacctcccaaagtgctgggattacaggtgaaccactgtgccccgcccaacttatgtgactctttatgctcacacagaaactacattctaggggtgcagagggtatattcatcagatgggagaaggccacggtgagaatcacatggctcagtctgttggtgtcagggtctgcaccgtatctgccctagatctctgggcagaggtgttgtttcggggcagtgcactttgctcactggcaggaaggcagccccgctctgtgcagccttccccagcagcctccctgaagcagcggggggatcagagacagggaagcacactgtgtgtgtaaaatactcttgagcctaaagttggagttttctcctttccgcttcctgttttttcatagaaaccaactgaagggttatgaattatttgttgacttaaaaaagtagatgtgtgtttttctgagctctttgtaacattgagatttaccatgtttactccaaaagtgtttcaaggccaagtagtagttggagactaacctggtgaactgtcacttgtaccctgagatgcctttccagcctccgcggtgggcattgtatgacctgcacgtgaatggatgggtgacccaagccacccctctctccctggaggttttgcttggtgtagaatgttattctggggacacagcactatatttttaactatggtcgagattagaggaggctgggccgggcacggtggctcacgcctgtaatcccagcactttgggaggctgaagtgggcagatcatgaggtcaggagattgagaccatcctggctaacatggtgaaaccctgtctctactaaaaaataccaaaaatttgccgggcttggtggagggcacctgtagtcccagctactcaggaggctgaggcaggagagtggcgtgaacctgggaggcagagcatgcagttaaccaacatcgtgccaccgcactccagcctgggcgacagagtgagactccgtctcaaaaaaaaaaaaaaaaaaaaaaaaagaattagaggaggctgagtgtggtggctcacacctataatcccagcagtttgggaggtcaaggagggaggatagcttgaggctggagttcaagaccagcctgggaaacataagtaagaccctgtctctacaaaaaaaaaattttttttaaattagctgggcatattagtgtatgcttataattccagctactcaggagactgaggtcaaagaattgcttaagcccaggagttcaaggttacagtgagctatgattgtgccactgcactccagcctgggtgacaagagagagacactattagttacttaactctggcatttgctatttctgcactaattgtcaaagttgactgagcattctcagtgccccttctgcccagtcatgggccataagcttgtgtttgggatagcatgtctctgtgtcatgtgtggcttgttatggttgcctggaatgaacttcaacacacctctgtttggctgagcgctgcatttgcaggaggtgagaaccactcagggcctgaggcagaacctgaccatgctcatttggaggagagggcctggggagcttagtgcgctcaagaagaaggcagatagggctgtgtgtgctgtagaggatgataaactgggggtgagggtgcaatgacgacacagtgccacattttagaactatgctctcatcttgtgcaaacaggtctgtttacagcagttcatttttatgagttacaattattatttctggataattttggtgtatggtaatcattagagtaagctgtgtgtctgattaaagaatttgtctctaatttatgccaatttaaagatgtcttctgtgttctctttgtctctgggggagggaagcaggttgctatggagacaacataagaaaaagtgacaggcaagaaggcttggcagtttcgattttgaaaatatttgtgatgtaggtaattatatatgtaataatgttatgcagcagaaccatctgcctttggagagatgcatgtcatggaatttcatggtaaaacagtgtttctcttaggaacaaaatgttatttgtgtgctattaagatattgaaattgtggaaaataaagatgcaatggagccctaagattgtttccaggggtgcagttgctgtatgatgtaaggtgccacctatagaatttggaaagctattttcacatggaaacaaaacatttgtataggaagacttacctgagactgaattattttatgttgtaaattgctaaaatcaactgtattcaggtttataactgattttgatcagtttaaatggcacaattttcttttttaaaaaaaattaaactatacctcatattgtttggggaccaatttaacaaattggcctatggcagtttccctgtatcatcattttcccagggatcttggcttagttttgctctaatctggaattccttcttttactcttacacagttgagcattccccctcccccatttttaaattctggtgagatttaaaagaagaagaaactttagcatgcgatttgttaaattcaacaattctgcaaatatttacggaatgcctgtgctgggcacagtgctgggccctcagacacacatgctgctgcccccatgggctcagagtctgagcttaagctctgctgagacagcatgcaactgccctgtggcacctacctggctctgctggcagagcaaagctgaggttttagttcacatcttcatgtgatggattcgatatggttgcagaattgcagatccacagacactcctgccacctgcaggtggggcatatcccttcccttaaacctgggctccatggctgctttgaccaatcaaatacagcagaagtttcccatgctcggtcttcagggatgggcagcttatgcttcctgtatcttggaacacttgctgtctaggagcccagccatcatgtgaggaagcccaagaagccctgtggagaagggcaaaggctcccagtaacagttacagctaagctccatgtgattgagctttcttggaagtggagccaccagcaccaaccgacccacctgcagcagagctgttcccaccaagctctgttcaagttgcatatttgtaagcagtcatttgactttactgttttaatacactaagtttggagcaagtttgttatgtaacaatagataaccagaatactgttttttctgtaatcctgtactgttgctgtgggaatatgccagtgtctaatttccttgtcagaggaagtgaggtcaagggaatcttgccctagaaatacatgtgttgagcagatgtctcaagcatgagatacttaagcatctccaggaaaaggcaaattcaggttcattctctcttactggcctgctagagaagatccttaaagagggccagtgtgggcatctggagaaggactgtaggatccaggccatcagacagaggtgtctttggccatgggcaggtggggttcatgttcacagaggcccgacatcaacacggacatatggacccagagtggcagtgctggccccagcacctgtagacccacaccaactttccgtggcagccagtaccttaaacaaaacccacaaatgttgcccaactttttctactgttgccactgggaagtgggtccaaaccctctgtgctgtggtctgcctgggcatcatagttgtgtacctgaggctggtggtctcatatgccgtggcatcaacacctgtttatgggctgtaggaaaactgagaggtcatcacattcagagattcccttgtgccaggtcctgcgcgggtgattttggtgaccatgactgagttttcttggctccagtggtgtgctggcaaacgtttaacagttggcttcctaggaagatgccctgagtgatagtgtttgtccatttccagggtgtaaacactcccacctggccgattccaagctgcttatgtgatgccatgggttgggagagctgcaaacactcctgagctgggagagcaggcctgggtacagcaagggaggcgagaactgtgcagtgtgttatctgaggaaagttcctagctctcatggggaagattttccttccttttgagtttcctatccactccctgctgtgtaggtggggaggaaagggagaaacgctgtgaatcagtcgactgctcctctggcaagcaggacccatttctaaagcatgagtcactacaaaatgtagctttttagatggaaaaatctatttacaaaccctaggtgagagtaaatggtttgttcacctcctgtgcttacttggtagaatgacaaattggacactccagtattccaagatttattattgtgacaaaacatatattacataaattttaccatttttaagtctacagttcagtggcattaagtacgtcccccctgttttgtaaccactgccactatttctgagcaacacctttccaaactgtgtccccattaaacacgaactcctccacgctcagcccccccagtaacctctgttatactttctgtctctgtgaatgactattctagggaccgcagagtcaaacagtatttgtccttttgtgtctggcttatttcatttagcacagggtcctcaggattcatcgacatagccgcatgcgtcacaatctccttcctccttcatgctgaataatattccattgtatggctagaccacattttgtgtattcattcatctgttcacagacatttgggtgtttctgccttttggctgttgggaataatgtcactatgcgtgtaggtgtacaaacatctgtttgagtccttgctttgagtttttttgagtatagacctaaaaatgatatttcaagatttttaatgtcactgatctgtgaagtccaaagcgggaaagcctggtcttttccgtgctccctcgttttgtctgtaggcattgagcacagtgaggctacatgttgttttcagagttgcccagcagcctggagactgctggagctgcatcccagggagacagtggctggagtaacaccaaccagacaatgagatgggacatctggggctttcaagagctcagggcaaatggcctaagcaggtggctctgcaggtgtggattgtgtccagctcagggaagtgcctgggcctggtggggcctggagtaaggggagaggtggggtctgatgagcttactccaggtgggaggcccaggaaggaggttgggttttcctcccggggttctctctgggtgtaggcagggaggaaagggagaaatgctgtgaattagtcgactgcttctctggcaagcacgacctatttctaaagcatgagtcactacaaaatgtagctttttaaatttaaaaatctatttacaacctaggtgagaaatctttattttaattgtgaaggaaaacacaaccccacttgacacgtggtggaattgctgctgtcctttcctgtcagagcctcccagtgggctgggtttggggatggatggggtgcacacccgctctgctcagttccttcttcctcctggcacacgggttgatgacagctcttcagttgagtctgttctgctctgtctggtagggagcacacctttttggttaatatgcccatttatgtgtgtctatggggcctctggagaaaacgttacttgcagaattaagcacaattaaaggagaagtgagccctgctgacctgaaagcaggtgggggctgctccttggctgggataaaaggcaaggaggcaaccctgataaatggcagctggctaggtggtgaggggatgtcctgccatttgcagcaaggcattggttacaagcctggattttgtttaacatctttattaataatgctggaggcaacagtaaacagcaatttaatgaaattcacagaagatgctaaatcaggaggtgttataaacagcagggaagccctggcgaggtaagaagcatggagcggaaggagtaggggccgtgtctgagaagaatgcagatgggcgcaactgcggtggagggggagcccagtcttccaggtatccagtaggagcggatcagcaagctccggggctgtcacagagcaggcagctacgtgctggagagcacagcagtggggagcattagacagacagatgcacatgagcccttcggcccttcctgcatttctttcttttttttttttttgagatggagtctcgctctgtcacccagggtggagtgcaatggtgcaatcttggctcacttcaacctccgcctgctgggtttaagcagttctcctgcctcagcctccctgagtagctgggattacaggcattcaccatgcccagctattttttgtatttttaggagagacagggtttccccatgttggccaggctggtttcaaactctggaccacaggtgatccgccctcctcggcctcccaaagtgctgggattacaggtgtgagacaccgcacccagccccttcccacatttctgttacctctttctagaaacctgaatgtgaatgccactgaattcaataaatgactgattgagcacctgcattggtgtaactggtgggctttgcggaattccagggagatagcgaaacttggaatgtaagctggtgaatgggtggttggtgcggcttgccgggcaatggtccgaatcgagcctctgggtggctgtggttttgtttggcttctggatgacttgtcagggtaccagccactggtgtctgatctgggattttcttcctcctcttcttgactcctcacttccctccaactccatgaaatgaggctgcccagaaaaggctgaaggaagtcagttggctcgctatggaggaggggcagttttcaattagagtctgaccatgttgtcgggaaagtaggggactgctttggctggttatacgtgactataaatcccaacttggacagtatttcatttagaatcctgacaaggaaaaacaatacaaaagtctcaaaatgaatttgttagcaaccatcctgactgcattgtgaggctttccgacagctccagggaggttggcttgaggtagctttgcccagctggctggagaaatgagatcaagtggagtggcttgaggagaagtcggctgacccacacatttgacagatcttttgggttcattgatctttgtcaatgtttcttctccagatagcaacctcccttttcttgtgttaaatggactcacctgattgtaatcacagaactaattgttgtataataaagacccattctctctttgcccgtggcccaaagcagccttctcccccacccgtcagttccctctgcccctggtatttccctgctggaggagttagacctcctggtgagctggtgtggggtaggtgccataccaggctgggcactggaagaacaagggtggatcagacacagtcttggctttatggaacttctgttgggtgggggagaaagatgattggaatatagtggatgatgaaaagacagatgctgcccacacatcccagggaagccctgtgctgagcggtgtgcaggtgtcggcagcagggtaggagtgcactctgagcaggtggaggatgcagtcctgggaaggctcggaggaatctgaaagcacagtcaagcagttgcatcactttgggtgctctgggctgcaagtcatgaacacccagtttttaaactgggtttaaaccacatgggcgcggttgcttattctcttccttggcaagaactctggaagtaggtggtcccagggctgcttctgagctcagtgatgtactcaggacatggctcttcctccctctttgcccttccacaccctggtgtgtccatagcataaggctatgtgtacgccaaacgcagcccgggcatcttgtcctccagtgataactgctgggtgacaggagggacggaccagggctcctcaaacctccctcattttattagggaagaaagtgttcccagaagcatccaggacacttccccttatatctcactggtgaggacgtggccccaggatctgcagggagcctggagaagggcatatctgccatctgaagcctctatcacctaacagggggctgggctcttaaagcaaggaagatgggggcattgggtggacaccagctgtgtccaacacagcaggcacctttgagccatgtcagggcagcaaactgtgtgtctacacaggcatactaaggtcaggtcaagatggcttcatctgtcacgtgtcagagcctggcctttatcctttaccttgagtggggaacgtggggatggttttaaataggaacgtgacgtggtctcactgtggtgtggtgtgatagggtgtggtgtggtgtggtggatgggctggaagggcagggttacagcccgtgggtcgttctgaggtcactgaagtaacccaagcccatgaggcaaagcctcccgggacactggtgtcagagtgtggaggaagctgactcagtgactgccctcagaggcctggagcagtccctgcaaaagacctgtggattgggtggacgtggcgggcaggggagggaggagctctgagaccagccctgcagttctggttggaggaaatggagggcaggcagtggtcactggacggcgaggaggaaggggtgtttctgccaattgtcttgggtgtgccgggtgcccccatgctgcgtctaggtaggggcctcagcaggctgttggaggtgaggctaagacgcagactggaagtgactggaaataaagctgtcagcatgtggtttatgggtaaaaccacaagagataagatcacccaaagggagtggccccaaaagctggggcagaagggcttgccttattctcctgggagcattgctaccctggcagaggaggggccttggggctgtgggggcagcaggaggccggggccacgtgtgctgtgtagagagttcttgtgtaacaaacctgcacactgtgtacatgtaccctagaacttaaagtattaaaaaaaaagagtcatagaaaagagaaaaaaaaaaaaaggagtggagcccaagccagccaggccctggcgtagaagacctgtgagacaaggactaagaaatttcattgacatgaaacaaaagggggatgattgaaagacagccaaacaggaatcctttttgaggaggacatctgaacagccctggaagaacgtctctgcctgacactcttgctggcatctgtgggctctctctgtcccgtggacaggacaatcagaagatgggctccactccagctgcaactctggtgacatttagctgtgtggccttgagcctgtggcttcacccctctggacttgcgtcctcacccctaaaggggagcaagatctatgtatattggagactgagttccaagggctgctgggggtgacgcggacagcagtgttttgggagatctgagacttggagggtggtaggcactgacaccacagcccaggagctctgcaccagctgtagtgagctgaggagagaaggggcacgtcgctgagctcacacatcttggtggaggcagagtaagatctcaaataatctgagaaaacagcttttgtacttctaaccagtaaagctgtccatggaaaaaatgagcagcgttaaaccttcagtgggacgactaacctccatacacatcacaattgaccgtgttaagcatctacgtgtctttctgtgtttctctctctctgagcattgctcaattatggaataagaagtctgtaacctcccctcatggtccctgcccccttactaatgtcacgggcagaggaaactggagggtaggggagaaggccactttgggtcatgggtaaagagagaataagtcttcattatacaattgttttgtgattaaaatcaggagagttgatttaacaccagagaagggagggtgcattctggagaaggtacgttgataaagatcagtgaactcagatgctttgtaaaatactcaagctagctgacccctcctcaagccactttacaccatcagaacaggggtgggaggtagccgggccctgatttcagcagtgtgtactcggagtgcactcctgcttctatgtgggttcctctcgggagagcccctgtctgatgtagttttttgcctgtgatgagtgcctctctgggtagagttcttcctcggtgactctggatgccaggaagggtgctgggctctcacctacgattttactgagaagctgctgcttctggaatcctacacccagaccgtgtgactcaccctgtgaactgccactgctaggacatctaatgggggacatcgctgcacagttgtacatctaaggatggagggatgagctgggatttgccctgtgttcaggttgcacgagtttgttccttttctttcttctgacatggaagcagatgttaggagtcccgaggaaccggcatacagagtggggtccacacagagctgcgaatgtggaactgggcttctaccgtgccagcggccacgtgagctgggtgcccatgtcccatggcttgttaacttccaagtctagaattttcccatggccatgactgcacccattcatgggggagctggggcaggaacaggtaagacagccaagcagtcagtctgaagaacggagcctgtcagctgctggaggaggaacccgggggacatcgtgaggtctggttcccagctcagcatcggtggggagtgagtcgggagagagagtgaactgggatccactaggcacctgcccatcattgcatctactgttgcctccctgcctgcttccaggtcctaactactttctctctggccagctctagccctgacttaaagggaaggggattaaaggaaatagcattctcagcttagtgatcccaccttgaggacagtgtttccacacctcacagcatatcatttatttagctccaaaaccaccctctgtgttaaaacggtgagatccactttgcagaggaggaacctgagtccaggggagttggtcacttgagggcggtgcagggcttatccatggagaagtggcagtgcacgcccacctggccgcaaagcttaagtgccttgcttctgtgatacagaaagtcagcagagaacacacagcccgaagcctgaggtggggcagagcgtttcctgaaggtgagatggccagccatgctctgtaggctgatgggtgcccaccctgcatgctcactggaacctcctgccctctctagccagtgcccaaggcagggtgaaactgtggggtcacatgcttgtctgatcatttgctaggacctgatttaaattggcatacaaatatatttttttaaattgtggcaaaatatacataacataaaaatttaccattttagccatttgtaagcaaacagttcagtggcattaagcacattctcattgttgtgaaaccatcaccaccatccatcttcagaactcttttcgtcttcccaaaccgaaattctgtccccataaacacttaactccccattcctccaccctccaggccctggcacccactcttctactttgtttctttgaatttggctggatttaagtggaattacacagtatttatccttttgtgttggcttatttcactcagcacagtgtcctctaggctcattcatgctgcagtgtgtgtcagatctccttcctctttaaggctaaatcctattccatcgtacggtcatccacatcttgtttattcattcgtctgctcatggacacttggggttgttttctgtagacaatattctgggagcaatcactcttttaataaaattctgtcttccattgaaccttttgggtatcttttattatggtttttcaaatacagagtccttggagaaccttggttgttctctttgtagatacgtatttggaactgcacttaccatatcgtgaatgaggctacaggtcaaattcccatctgaacatcaccctgatcttgaccttagtctgctcaccagatggtttgtctcagctccaggtttatggccacgattggtaaatagactcactccacatcttagtaataggaagaagtcatcccgggcttccccagacttcaagtatctttagaatgttgagcttccggcagatttttctctaccaggacctaccacatcctgcatgtgttataaacagaatcagtccaccagaatgagaacaacctgccagtgatgggaatgagatgaggaagctctctcaccggctagaagaccagatgtccgaagacctttttgggggagggtggggtgttgcctaacaccaaataactatggccactcaactaatagatcattcttctcccgcctgcatctgattgctggcctggctgtggtgctgggcaggctggacaccaccagcttcccccaggcaggggagcccccatctcccccatacaggggatctctgttgtggcctggcacaagggagctggcccggctgtgggtggccttgcaagacagctcagccaggacctttccctcgagggctctgccttgctcctgccggttgccttcccacaggtgtgcggactcgagtttgcttggatggaaccaggtgccacaagtgaagcaagtggcagacagctgcggggaggggtgctgtgttgtggtaagagtagtcaatagaggtttttggaaactgagtagagacagaaaaccattgtcctctccttttctgttctattaaaaaaaaaaaatcctgcctggcctcaccagtttctgaggcacgtgacaaaatttagttttcatcagggtccttcatgtggcatggcacaaaaaaagacatttcagtatttatttgaaactttcttggctctcttgcccccgtttttgtggcttagaggaaggtgtggatttcttctacttcaccagaattgtcctttcaattcaaaatatgggcttctgagttgctggatgaaatgttctagaaacagtctttgagtgaaaatgttatgcttaacaaaacgagcttcagtttccacttcctttctgctatacaaacctatgtggtgctgcttattaggcagaaatagaagagcagatggaagggtgtgtggtacggatgccttctgaccacaaaatcaaacaatagaccttttcatctctcggtcaaaatacagcctcatcacctctcctctcagccaaaaagcaacacagaaatgcacagtttgggcataggagcaggccctgccggccagcaggagtgagggagggtggtgttttcttgccctttcatcatggctggactttggcactttgttctctaagtgaaaacaaaaatagccactgacttgggctctgactatatttgctgtttctttaatgcttctcttccttgctaaaaatacattagaggtgattaatcaaacacacacacaaacacacaaacccacaatcaatgcaattaaaaatatataggtggagaaagacaagaaccaggtgagagccctgccttccctgcacggaccaggcttgtagaggggtgtgtctctcttcctcactgtttctgttctgggattatgcctgttatgggcactgacctctctttcttggctgcagtgccatttgggggctcagtcctcatttagctgaccttaatttggatggttcccaactttccatcaactggcattgcacatgactggctttgtggagttccacctctctcgctcacaccccattcacaatgaggatagaggggctaccgcctggagcatgggaggatcctgaacttgggagcttccatgagagaatgtatttgagttgttctcagactaccgtttttgctcagcacttttttggggggctcagtattatttccaaaacattttgtgtaattacataaggtttctacttctttaatttgccaagtaaaatgttaaaaaattttcaccatcacttaataaaacaaggaacattttagtattgcaaaaggaggaagaacagccatttttatccgacatagaattggaagctctagacagagaaattagggaaggaaaataaattattggcttccaaattggaaaaaaaaaagtaaaattatctctgtttgcagatgatacgatcttatgcatagaaaactctaaggagttctcagagttttcagagctagtaaatgaattcggcaaagttgcaaaatataaaattaaagctcacagttcagttgtatttctatagacttgaacaatccgaaaaggaaataaaaaattcaatttgcaatctcatcaaaaagaataaaatacttgggaataaacttgaccaaagaggtgaaagattggcacactgaaaactacaacatgtttttgatacaaataagtggaaatgcatctcttgttcatggattggaagacttaatattgttgagatgacactactactcaaagtgatctacagattcagggcaatctctatcaaaaccccaatggcgttttttagagaaatagtaaaaaagcactctaaaatttatatggaatctcaagggaccccaaataaccaaaacaatcttgaaaaggaggagcaaagttggaagactcacacttcctgatttcaaaatgtactataagcaatagtaatcaaaactatgttattagcataagggatagatatataaaccaatggaatacaacagagatcccagaaacaaactgtcacatgtatggtccattggtttttcaacaaagaagccaagatcagtcaatgaggaatgggcagcctttttaacaaatggtgctgggaaaactggatattcttatgcaaaacaatgaagtcagacctttatctaacatggtctagaaaattaactcaaaatgggttaaagatctcaacataagagctaaaattataaaactgttataagaatacacaggtaaaaaccttcatggcctggaattaggcaatgatttcttgagtgtgacaccaaaagcacaggcaatacaagaaaaaaatacataatttggatttcatcaaaacgcaaaagttttgtgcttcaaaggataccatcaagagagtgaaaagataacctaaagaatgggagaaaatatttgcaaatcattgtttagtaaataatgaatatctggaatatataaagaacttctataactcaataatttaaaaaacccaattcaaaaatgggtcaaggttttcagtaaacattttcccaaagatatacaaatggccagtaagcacatgaaaagatgcttcatgtcatttgttactagaggaatgcaaatcagaaccacagtgagaaaccattcccacctgttagaaggggcattttccaaaaagtagaagataataagggttaggatgtggagaaattgttatgctagtgggcatataaaatggtacagctgctgtgcaaaacagtgtgaaaggagtttgaacatgcaattactgtataatttgaacacagaattaactatataatccagcagttctattcctaggcttatacccaaatgaattgtgaaccgggactgaaacagatatgtgtacaccaatgttcataattgcattattcataatagccaaatgtccactgacagatgacagggtaaacaaaatgtggtatgtatacacagttgaggaatattcagccttagaaagaaatgaagttatgacacgtgctgcatggatgaactttgaagtcattatgctgagtgaaataagtgaggtgcatacaagtcatgcacagaggaaccatggacctggaataaaaagtcagtcttccacatcctagtcagcctctcttaatttttttcttttcaataacagccattctaactgggtggaggtgatattttattgtggttttaatgtgcatcttcctggctgggccaggtgactcacggctgtaatcccagcattttgggaggctgagacaggcagatcacttgagctcaggcgtttgagaccagcctggccaatatggcaaaaccctgtctctactaaaaatacaaaaattagccaagtgtggtggtgcacgcctgtaatcccagctactcgggaggctgaggcagagaattgcttgaacctgggaggcagaggctgcggtaagccgcgatcgcgccagtgcactccagcctgggtgacagggtgagactccatctcaaaaaaaaaaaaaaaaaaaaagtgtgcatcttcctgatggttagtaatgttgagcattttttcataaacctgttggccatttctgtgtcttttgagaaatgtctcttcctttccttccccaatttttaatgggattaaggacgtggagaaaagggaactcacatatactattggtgggaacataaataaggcagccactatggaaaccagtaggaaagtttctcagaaaacgaaaactagaactatcatatgatccaacaatcccactgctgggtatttatccaaaggaaaagaaatcagtgtatcaaagggatacctgcacccctgcatttattgcagcactagtcacaatagcaaagatgtgaatcagcccaagtgtccatcaactgatgaatggattaaaaaaaaaaaacacaggggatactattcagcctttcaaaagaatgaaatcatgtcatttgcagcaacatggatgaaactgcaggtggttatggtaaatgaaacaagccaggcacagaaaggcaaatattggacgatctcactcatatgtggaagctaaaaaaggtgctcgcatgaagacagagtagagtgccagatgccagtgtctggaaaggatgtgttggtggtagggaggtaaagaaaggttggttaagggtataaacatacagtcagaaggaatgaattctcgtgtttgatagtacagcagggtgattagttaacaacaatttattgtatattttacaatagctaaaagagatttgaatatgtcccaacacaaagaaatgataaagatttgaggtgatggatatgctagttaccctgatttgatcattacacattgtatgtatcaaaatattatatgtaccccataaatatgtacaattattatgtatcagtaaaagttcctccaaaaaaataaaaagagtccatccttcagcagagggagtgcattgttggaggggcaagggtgagaggccaggagagcaggccctgggcttagcctccagcatccacagcacgcgtgtgccctggactgggcctaggaagggtggtgccctggtggcctatgctggccctgtggagcctggccaggccttccctgtacctcctccctaaaaccctgggatggcgtgggctcctttcttctaccactgacatccagtgtttctgttaaattaggtggtctgcctaaggactttttggtttgctaaaagacaaaacaaaacacaggaaataaagcacattttccagttctcagccagcagcgcaggtcctctgtgaccacatggcatccccaaggtgtccgcgtgtatcccacatggggactcagccagctgtgagagggatggacctgcccctgcctggggctacggtccccatactctcccatcaacagggtctgtactcactgcacccttcagggtgaagagggcactgtccgcccctgtggccatcagatggtgtgatcccacctcttggcagaggctggcaccacgccctgatgcttctccatcccagacagggggaagcaggtggttggagagaggtgggaggatgaggttgccaccttctcctgaaaccagcatgggtgctgctgccacagatcatgaatgctttgtccccctttgctgccgtcccatgcagtcaagtgccctgataaccaggagttggctgttaccagatccagagccctcagaggctgcgtgagcaccagccacgtgagcagcctacctggtgtgtttcccagagccgacagagccaagaggggcgttctgaagcccgaagaagcaggagtggccactaggagctgccgtgtgctcgctgtgatggagttgccgaagtgctttgattcctcggttatttcaggcattgtccccctttgggagtgggcatggcctgcccatgtcagtcctaggtcagtggctggaaatgagcagaatggaagcgtaggaagggcttgaggggtgtgggcacatgcttcagctgcgggctccattcaagcatcggtggagggcagtagcaccatgcagacaactggagctccttagtgctccctgggtagccctgcacctctccatggctctcccctgaattctgccccccacgtgatgctgccccaacgtggagatccgggatgtgtcgttgtctttccttgcagagccgtggaggacagcctctgagccatccctgctagtctctgctcctggcacatgaaagtgttcaatacatgtttgtgcagaaagtgaaattaaaatctgtccacttggtagctggatgtggtggcacatgtctgttgtcccagctactccggaggctgaggtaggaggatcagatcacttgagcctggggggtgtgggttgcagtgagccatgattgtgccactgcactccagcctaggtgacagagtgagactccgtctcaaaaacaaattcaatcaataaaatctgtccacatggctcattaatggatagaatgttaagagctggaatagcttcagggtttacctagcctcgccccttgttttacacaaaaagaaactgaggcctggtctcccacttctgcccctgcttggcaggcctagagagtgtgtgtgcatgtgcaaatggagggggtgtgggcattgggagtttaaacttggcttgaatagctaatcagatctatcaaaattaggtttttaccaagcatagtaaaataagacttgtttggtattattagtgatgctaaaactatatgtcacatattggacaaataagcacattttcagatacgcatgtgggattttgattgcatgctgggtttagtccaagattaaatctgcattttgttctgatgtaaaagggacttgaagcagtttttgaggtcatgtgcatagcagcagtgatggaaatgtcctgtgtctgctctgttcagtacagtagcgaccagccacaggtgactactgagctcatgaatgtggccggcgtggctcaggaagtggcttttaaaatttcattttgccaggcgcagtggctcacacctgtaatcccggcactttggaaggccaaggcgggcagatcacttgaggtcaggagttcaagaccaacctagctaacatggtgaaaccccgtctctactaaaatacaaaaattagcccagcatggtggtgggcacctgtaatcccagctacttgggaggctgaggcattagaatcgcttgaaacctggagagggaggttgcagtgggctgagatcatgccactgcagtccagcctgggtgacagagcaagactctgtctcaaaaaaattttttttcatttaattctagtcaattaaaactgaaatttaaataattacctgtggctagtggctactctaatggacagctagagaactgcagcataaccttatctttttaaaaatcttattttaaaaagaattttgtgggtttgaaggaaagattgtctggaagaaggaagtgactgagacatagctttttgacacctggcctggagccttttcgtttagaccaaccaactaagctggatgacaccagcacagtcccttaaattccctggcctcagtttcctcttgtgtaaaatgaggttctatggcttctgctagttctgagattctatcttgccccattcttggcaactgggatatgaagagctctattttaataacgataataataaagaaggcttattaaacactggggatccggctgaatagtcctcaaaccattgtactcagctgggtggagagacctgcaagtaaccaagggaagtttcaaaatgtgggtttccgggctccgcttggacccatttcacagggacccgaaatctgcacgttaacaggtttcacaacgattctcacacaaacaactccctttaaagatacaggccaggccgactccccactggggactgggtgggctgacccacctggcccactcacactcaccatgtggagttttctcctgagagttaggccagggaatgatttttaatgtgggatgctccacgttcctctctgggacttcccatttgcaatgtcttaagtcactttcatgtttgaatttagaaaatcaaaagatgaccgtcttgtttcctgtaaatatcaggaacagagaggagagcaggtggtgtgtttgtcctagacttaaattttaagatttatttttataagttagtttcaagtttgctttctttcgttcttaaaattgagatagggtctcgctctgttgcccgggctgcactgcagaagtgcgatcccggctcactgtagccttgacctcctgggatgaagtgatcctcccctctcagcctcccgagtagctgggactatagtcgctttccaccatgccagctaaaagtttgctttcaaagagtccctattctaatctgttgttggagctctccacaatgaatcaccaaaataccattttaatattagagtagtattttgtcaggaaaaaataggcctgaccctgaacaacttatctgcatagctgtaatattgtcatttttgactcaggctaaatcacttgttaattttaggaggaaatgtcagaggaggttgtccccaaatagcagttattatctgtttcccaggtttatgaacccagctcacagctctgcttgtcaacatctgcagaaggaacttagagaaagactggctccttttacattttttttgttacaatagttaatgtaagagtagttatgtaaacagatcaataagctcattttgaacatgaccctgccaactgtttcaaagctaaagtcacattgactcaggaaggtcagctgtttcatctacagtgtctgtggcccatggaggaactggagccatgtgaggtctaatgacacacgtggcccatgtgcagtcctcatcgttaagtaagtaccctgctgacctcttaagacataaaccaaaaataaactgtagcaaccacttctttttaagtccctttaaagtttagatttttactgttcttagggtgactttgtggctcatcactcttagctttttctcattgcttcttgaatcgctcccctttcctgagtgtttcttggtctgccatcttgacttctcccggggccatgcatctgctccctttgtggctccgtttgctcctaagtctttgcaggatctccacgcagaaggcgtggtgctggatctttaggggacattcagatatagacatgctttgtgccattaaggaacttgtggcttagtaagaagaacagctggttacagaaatgaaccaggacccctacagctgcaggagagaaactaactggaatcagtcaaaacacagagagaagcaaagccgtgtggtggcccagataaccaagggtcctgaggtagatgcatccaccatggccgggttcatggctcagatgatgccatcaggacttggtctctttctagctctgggtcccaccaagcttttccatggtggcctagcagctccactgtcctcttcataggtgcaagagggctttaggggtctttgtcatgtttctggggtctttgctggaacatctgcagaactcacgagattcactccggctgagtgaactgatggcagtggcagtggttggctcagacttagggtgtgtgttttctcctgaaattgagaggatcccacccaggcctcaggggctgaaagttgggggaaggagctaagagaaaattggtgcctgtagctagaagaagctctgtgaatgtcaggcacacaaagctacacgtccatgccagaaagtcacaatactaagggacttctcaagtcctggttctcaggtccttaggggtcctggttcatttctgtaaccagctgttcttcttactaagccacaagttctcacagtcaagtaaaaaccaaatgcgactggagttatgaggatggtgacattgaagctatcagggactgcttcatgttgggtgctttgtgtgggctcccgggtctgcctgggccctgcccttcatccctgtctgcttctctgggagatccctggctcttgggattgtctgtgtgtgggagattcccctggatctggcctggccatgcccactggcttcatggggtacacggcagctcccctgcttctgtgctgtgctccctgcaggtcacaggatccacttctctgcaagtgccagaatcttgtgcagtcctttcgggtccaacgcaagttctttttctgggtaggtcaccccccagccaactggagtcaacacttcctttcccgaattcccgctcactctggcaatctcccttggcccttcggtcgctccgcctttcatcggtttgtctgcaactgcagttccctgtaggcttcatgatggtgaccgtcattcctgatgtttcccaaacaaacgtgcattggtgcttttctggctcaaggggcatgggatttacatttgctgtgggtaggaaagagtggggaatagttcagtgttttcctttatttgtaggaaagtgatgcccagacacaggtacgagtgtctggtttggtacttttactctctcttgacacatacaggcaatctctaatggctgtgttttcatgctgcaaatgatgtacttgcaacgtttggcaaacatggtgctacttgcttataatactgtcagaaattcaatcggcagccctcctagtccccaggaatgtgcttggtggcaggtgttagcagtgcgtgtctatcccccaaaggcttttattgtctcattaatgagcaggtgcaataaatgtgttgtagacagcatctctgttagtctgaagatgtttgggatgtgtgttctatttccacatgtcaccctgtagaggaaaaccaactgttttccttgatacccacaatgcacccagaacacttctgataccagatgtgtgtggggttttgccacaccaagcaattctccagttgtttgcagatgccaactgggtattcagttcagttctgaccccttccatgtggagctagtatggaccctgcaggttaagggctcaatctcatcaggctgccttcacttcagaggccagttgcaagaggtgtcttcaggttacctggaacttctgtgtggcgtggctgcaaatctggtttattatattagtggagggcatgataaaagatacaggcaagcagccagatggagaggtacatagggcgaggtctggaagggtcctgagcacaggggcttccgtctctgtggagttagatgtaccctctccaggtgggtggatgcatccaccagccagaatctccccaaactccaacttgtagggatttttatggaggcttcttcacacaggcatgattggttatcaacacaatatccagcccctctgccctctttggaggatggggtatggagctgaaaactccaagtttctggtcatggctaggtctttctggtgaccagccttcatccaggagccaccagagtcacttcatcagcacagaaaaaaggtttccatcacccagcaaataccaagggattaggagctctgtgttgggaacctcaatcaaagaccaaatatcagaacaaaagatactcctagccccgctatcactcagaaaattaccagggatttaggagctctgtgccaggaaccagggacaaagaccaaatatgtatttttattatgtcacacagctgttcccttccccctttttagtacacttcttatttggagcagtggtgagtagagtatgaggaattctgacatacccacaccccacttcctctgttgttaacaccttacattagcatggtacttttcatacattaacatgatagttctccatttgcaaagctgtagttttttcctgccatcctttttctgtcccaggatcccatactgcctcacagctgtcatgtctccatggactcctctggctatgacagcttctcagactggtcctggggtggtcacggcaggtggatagtggcctggagcttgagagcccgatacgggagggatttgggatgtgggctctgaattggtgggtttgcattaaaaaggcacactcatgagcaagttgttcactatctctaggaattggcagcccctccagggtcaggaaggccccagatgtgaaagcatcagcatacagaaaataagacatggtgactacatctaggtacctcgtataactggaatcatagaatatttgtcctttgtgtctggcatgtcacttaacatcatccaggctcatccatgttttggtatgtgtttagattttttttcttttctttttctttcttttttttttttttttgaggcggagtctcgctctgttgcccaggctggagtgcagtggcgcaatcttggctcactgcaagctctgcctcctgggttcacgccattctcctgcctcagcctcccaagtagctgggactacaggcgcacgccagtatgcccggctaattttttgtatatttagtagagacagggtttcaccatgttagccaggatggtctcgatctcttgacttcgtgatccgcccgcctcagcctcccaaagtgctgggattacaggtgcgagccaccgcacctggccgattttttttttcttcttaaggcagactaatattccgtcgtatggatatactatatattgtttatccattcaaatacggacattcctcaacttgggatggtttgactttagagtttttgactttatgatggtgcaaaagccatatacttccagtagaaatctgtaaccctggccaggcatagtgcctcacgcctgtaaacccagcacttccgagaggccaaggtggggggctctcttgaggccaggagtttgagaccagcctggccaacatggtgaaaccccatctttactaaaaaaaatggaaaaattagctgggcatgatggtgcatgcctgttatcccagttactcggggggctgaggcaggagaattgcttgaacctagtaggtagaggttgaagtgagctgagatagtaccactgcactccagcctgggcaacagagagagatcatcttaaaaaataaaaataggaaagaaaagaaactgtaaccccattgtaagtcagtcttccacttatggtggggttatgtcctgataaacccattgtaatgtcagaaaatcgtaagtcggggatcatcagctatgtcaccagcattaagtacattttttaacttatgatattgttgacttaaaatgggtttgtctggacatgaccctatcataagtgctggagcatctgtgtttgtttctagagaagataaaaaattccacttcatttctaaatcccctaggagttcactggccaataggactccctttgggggctttgggggcttctcccatctcggctaagggacagctcaaacaggaaggcaggataggtcaaactcatttgcagtaggagttgggttgaattgtgtaagacaaaagtacactttgttatgtgtgattaattgtcacagttcctgaatgtcagcacggacagagcagcagagttggcttctgggacacagtttccatctgctgtccctgcctggaaggaggcttaggtggcttgcctagcatggacttagtgaccccatctcctctcctcccggagccaggccagagcggctttgccgaagtctcggatgaactgtcaggctggagcagttcttcatccaggggctgtttcctgctctaattactgctctttcttctacagctgagaggaattggtgggtggatgtgggagaggtgagctaatgcgatgacattttgacaagtgtgttacaataaaaaataactcccctgggagaaggttaatgcagttatcaccacgttcatgttggcagccttagatctgtgcctggttggggcaggatgctttgcttttctcgtgcagaccaagtctcacccacattctaatggctagtgcttaaatttttttccagaaacatctatgaagaataaatatcgtgctctgttcatagatttttccacttgggctttttgctgtatttctttattccatgataagctacttctttccacctactagttaagtaggctgcttccctctgctctcagatgacatgtggctgaggacttcatactaacattagcctaagtaaaaatataattagtatttttagtctgcttccaaattaaatcttaccgtgcatgctaaaagagactacagagcatttgggatttatttgttgtgttggatcttctattccttgttctcctcttattcatttttagtaatgtagaatttactctagctggattagatatttgccattaagaaaaacagctttattgagatgtaattcacatgccatgtaatttgcccttttaaagtgttcaacctagaggcttgcagtatattcacagagttgtgtccatcaccacaatacattgtagaatattttatcctttttagtactgatgtgtatgaatctgccacgttttatttatccgttcattagatgatggacatttgggttgttttcactttggggctattatgaacaatgccgctacaagtatttatgtgtaagtgtctgtttggtcttaagttacgtttctcttgtagtggaatgaccagatcatgtggtaactctgtttaaccatttaaggaacttccaggctatttactaaagtggctgcatcactaccacccaacaacataggagaattacagttccccatatccttgccaacacatactatgaactgtctttttgactgtagtcatcctagaaggatcattttttcagagttggaaaatggtagagagtagttgctaaaagtataaatatggctcaggttagtacttatcactaactgtgttacctggctgagtcacttaatttctctgagccctggtctgcctatctatctgtaaataggagatggttacacctgtcccgtagggtgcttgtgaacactgactgagggggaaatgaaacagcacagcgtctcccatgctgtaatgttcaataagcgtggacctttctcatcatgcctaaaaggagaccaactgtgagtctctgcccctccttctaccctgtccatcccttctttctggaaaggggtgattgattaacaatgttttagagaaatgtgggatcatccaaagcaaagatgagtggataggaagcatcatggtgatggaaccaggagctctatgagctgtttctggatattccctgatgataattaaagggtcccctaaacacagctgagacttccattttatacttgaaaactaaattttaatgcaaaattttatcgaggttcaatttatacacagtagaattcacactttttggtttacagttctgtgagttttgacaaacaactgcagttgagtgagcaccactgagacaggagagttcccttacccctttgtgagacttgcgataggggtgtggcttgcttacttggccaccatgtgctcaaaccccttgcaggatgggaagcacgcagatgagtgggtgctggggccggagctagtgcttttgggctccatcccacagcagtggcgaggggtgtgttacaattaatgctcctttagcagttgctgtccatggatggctaggtgttaaccagctcagtggacagtcagggtgacagcttcttacaccttgtcctcttggtacccaggttcttgtccagcaccctggaagaatcaggtctcatggacttgaaggatggtgaatgcagaggttgtattgagtgatggaggtggctctcagtgggttggggacctggaaaggggagagagtgggaagataatcttcccctggagtttggctgtccccagctgaactcctctctgaccatccccagctgaattcctttcaatgttcagacacttcgtgtcttccctcctctgctgcactgctctacttctctgccagtgcagtttgggggttttataggtacaggatgggggtgtggtgggccagggtggttttggaaaaagcaacatttgagtgggaaaacagggataactgttctcatttagggccatggtgtccaggcttgagggtggggcctttgccggggaaccaccctcttctacccagtatttccctgcctcctgttcgtatcaccaccacactcaagatgcagagctctatccttttggctcggaatattcatcagctgtggccaccctggcagtcccacatcagctttctgttcctgccgttttgcatttccagaatgccatataaataggatcacagagtatgtagctcttgagtctggcttctctcacttatgtagcacatttgcgattggtctgcattgttttgtctatcagtagggtgttcctctttattgctgcataatattccatcatatggaggtaccacagtttgcatatccatttaacactgaaggatatttgaattgtttccagtttttggcagtcattgataaagccacagtaaacattgacatgaaggtttttgtgttaatatgtttccatttctcttggataaatattaacatttaggagtagaattgctggatcataaggtgaatgtgtgtttaatttccttataggaaatgccagattgtttttcaaaatagctataccatgaagttaatagtattttaatcaataataggccattggaatctctgaatttgttattagtcagttacttttctgaatggactagattctgaaactgttactaaggatgccagtaaatgcacctttcatggacagttcatataggaaaactttaggttagatgaagtgaaactgtttctttattgcaggattcttagtgcctaaaacataaggcccttaaggggacagatgaaacaggcaatttctctaaatttttttgaccacgaatgtctcatggagctagtgttctttggaaccaattttggggaacactgggctagagaacacacattcttctcagcgagtagcttgtattttatctgaaacatttctgtattggtcaggataggctctgttgtgctgcagtaacaggctgccctcgttgacagctgtttaaaacaataaatgtttgtttctcattcacgctgttagattatctcagcaggcacagggctctgcttcttgttgatctcacaggggtgtgggctgatgagaagagagtgaggctgatagcacacaggctcttggagtcttctgtgtgggagcagcacacaccacgtttatttgctgaaacaaattacatcttcacacctgacttcctggggaaattcaaccatgatatgttcctgagaaaaagagagatggaatattgaacagttctagttgccacctcagattctaaaggattcagggcaaactagtttgttccattttgtgtttctgtgtatctgagttgttgtatgagtgtcctaacctcagcacctgttgtcaccagatcccaacgtttgactatggcatatctttatctgatatctttagaagctgccctggtcccttcagcccagtaggccatcatgttctcctttatggtgaggcagagctttagaaccagaccacagagcaataagcagtacggttttagagttgggaggggggccctgggaagactgtctggcccatggtttctaaacacttcagagcgggaggaacctgtcttctaatgaaggtttaaggacagcgagcatgtaaaatagatcaaccctgaatagttctgggaggactggttggtgggccaagaattctcactgcaaggtctttcttctcccctcccccttcctacctcctcttcatccaccctagggatctctaagggccactaaagagaccagtttgagagaccctaatcttttcaaagcctttgtgtgtgttagctgaggagagtgactaggtaccatacaaatcaggttacttttgagagcaaggggccctattaaccctcatgccaggacaacaggtgtgggtggcacatggggccatctggtcacctggagagcaagaagcaggtgctgctggaagtgactggtaagatggttctcctgggtttgagagatgccatggcatgggcctcgaaggctgttgtttgtttgttttgcttttgctgttttttggtgtcattagagggagagagggagagtgtacgtgtctaccaacataaagattgaaggtgtgcagtcgaggcatccctgtgggaagtgtgagctctgatgacaacacttgttagactctctactgagcccctctctccctgttcttatttcatcttcacgtgcactcggcaccagggtgggcctcctctcctacatgcttgactgataaaacctcttaaccctgccaagccagattgcacaggagagggccttctaagctcactgcccttactttaagaggctgtggggttggtttcaccttgacctattataatatgcatgctcactgcctttactttaagaggctgtggggttggtttcaccttgacctattataatatgcatgctcactgcccttactttaagaggctgtggggttggtttcgccttgacctattataatatgcatgaagctattcacattttgaacctctccaagatcaatagtttatttctgggggacatttttagaactcttaatcactgccaaaagaaagaaaactttctggaagtgaaaactgcctcccaattacaatgtaatatacttgcctttggacctcttattaatgaccaaattcccctcggtcctaaagtccaggttgtttctgcatgcagtgtcggggcaggggaataatgagcaatgcccagcagtgcctccagagtgtgcgagcatcccagtgaagcactctggaagagctcccatgtcattggagtaagctgtgcatcacttccattctctttctcctcaaacttcaccttgagcacacagctgtgagccgtgttttttaggaatcagaaaaggtggtcttcttgggtcagtgcattgtaggaaataaatggtatattttgttttggttatttctttgcatacacttggttgaagatgacaatgaatgagggctttattttgttgagaaacagggacagtaccattaacattaccacgagaagatgctgcccaaatggggagattaaagacgcctaaaggtcaaggtcgaagaaaggaaatcccaggtgacactgccccttattttattcttacagcatggactgtttcctgtttgcaaactggtgctgccctgaagtgaggggtgagccttcttagccaggaaacagcctatacatttaagaggactctcctcagagatcaaaattgcaggtacagtctccggctgtgaaacgctgcagtgacctgtacttacagctcaggggacaaggcataagtatagttctagggcagggagaggcagtccccagagaaatttcaactggcctaagggtttaatattaaagaccctggacacagaaagatcaggggaagctaaacttagaaggtagagaagccaacacaaatgaaagcagtgacatcatctcactgcaaacaatgttaaaataagaaataaacaagaatgtcaggccaaaagacaaaatacacatggaggaaagatgttcacggaatagattttaaagagttaatatttgtaatatatgaacactctgttaaaagtggttgtttaaaactactaaaaccagaccaccagcaaagaatgtatagaaataagtcagtagaggaactgacaataattaatgttggaagacatttatctttatcagaaaacatggagaaatgtttgatcttggtaatcaaagaggtacacattgaaaaaaaatgttgtttctcagctttcaaagtaacaaagagtataaaaaagtgcacagtcttaacaagtctatggagaaggttggtggaaggctggtgaaataatgcttttgggaaccagcatgatggattggaagtctttaaaacaagcttgtccaacccgcggcctgcaggctgcatgtggcccagggaatggctttgaatgtgacccaacacaaattcgcaaactttcttaaaacattatgagatttttgtgtgtgtgaattttttttaaagctcatcggctattgttagtgttagtatattttatgtgaggcccaagacggttcttccagtgtggcccagggaagacaaaagattggacactcctacttttaaatgcccgtgtctttgatttagcgatgacatctggggatcttccaaaagaaaatcatcctgaaaacaaacacaaaaaacaaatactttctacacaaagtttccattttagtataaaataaagcaaaaaatgaagaacaacttggatattattaatagtgtggagattgctaaataagctatggtatataaattaacttagtgttatgccaccaaattaaaatggtttttatgaccacgcaatggctcatgcttgtaatcctagcacttgaggtcaggagttcaaaatcagcctgggaaacatgatgaggccccatctctacaaaatattaaaaaattagccaagcatggtggcatctgcctgtaatcccaggtggagctgaggcaggagcatttcttgagccttggagttggaggctgcagtgaaccatgatcatgcgggtgcactctagcttgggtgacagagtgaagcctgtctcttaaaaaaaaataataaaataaaatggtttttatgaagactaattcaatagaaaagtgttggctctaaaaatgaagcaggataccagatggcaagtacactaatatcactgtatttttaaaaatcttataaatctatgcacagagacaaggctggaagacaactaccagagcatgacagctagattgtgggtgctttaaaaaattttctctttttctttaatttatacatttcttgtttgttatgtatatttgtgtgtgtgtgtgtgtgtgtgtgtgtgtgtgtgtgtgtgtgtgtgtgtgagagtgagacagagcctcaccttgttgcccaggctggagtgcagtggtgcgatctctgctggaaactggaaactttggaggggacattttttcaggaattctttttcgcattatggatgccactgtttcagagtttcttaaacccagagtgtgatgaatggaggaggagagtgctcacaggatggcctcactccacagaggaccggatgcccttgttgctcaagacttccttcccccaggcagctgctacatgcttgcatcctctgtggctcttgcaatacagaggcaaggcccctgatgaaacccggcgaggtgtggtctgccctggaggacagcagccagtgtggggggcagtcccttctctctgtcccaagggaggatacagctccactgtggtcactggctctatgtgagggggtgcatgcatcagagacaacagatgagagggcccttcagttggcttttctgcctccagttctttctgttcatgagaggaaaagctactggtagacagaacaatgttaaatgtaataaaaataagcaagttccctgggtttatgcagtgccaaatgtcaagatggttgtatacaggagaagacgtccaagacacgtcttttccgagtgtcccagagctcagaactctgtgagcactttgagcttccccagacctctttcttccctgggtgtgagccctgcacagtgctccgaaaagagctggggtccgtaaatacggatggcaaacagctcacctgggtttctcacatggatttgttttcttgggggtctctgtatggaagcttttatcccttcctagggggctataggagtatttttgttaagattcaatgggtcatttccaaagtagtcatttctttctcctcacacaaaaatgaactgaataagaataaggatacagttttctagtgaaaattggggtcttccctgctccttgcctccaatcaagtaaaagctttttagaacaaacggactacaatattctgaagtgattttgaatttggccccatatttgactctgcggtccgatgagggacacggggttagtgggcagacaccattgtttgcacacacgagactgggtacagagccaggcgtgatcatccaggataacagggaggaaagagaggccgatgaagccactgatttttaagagctttcttggtggagtaatagattttagggagggagttgctctgccaagtgctccagcttaaatggagccacctgtggaaaggagctggcggcactgctgtgggagtcccttgtctttgggaggggtgtttcacggccacctgcctttcatccccacagctcacagcaacttacagaatttccgaccgtctccttggagacttagagaaatgtgtgctgaaggtgaggagtcactcaatcactggcagccaggcggaggtgactgatagcaaaatgtgctctagttgtagtggggcttgcagctgggtatcctctgtggaatgcttgctggctcatgatagatgagtcacttgtctgtagtggtggccggggctctggcccagacccttctctgttttcttatgtgagtgaaggctgttgtattgcatagtgggtgaaccacacctggggattctagacttggcactgccctctcttcttgtggaaccatggatcacccatttatcacctctgggcctcagttttctcacatgcaaaatcagggttgaagccaggcatggtggctcacgcctataatttcagcactttgggaggcccaggagggcagatcacttgaggtcgggagtccaacatggttgaaacctcatctttactaaaaatacaaaaaaattagtcaggtgtggtggctcatgcctgtaatcccagctacttgggaggctgaggcaggaaaattgcttaaacctgggaggcggagcttgcagtgagccaagatcgcacctctgcactccagcctgggcgacaaacaaaaaaacaaacaaacaaaatacaaacaacaaaaactaaaaccagagtcagggttgggcttgatggtccctatcagtagcagagtcccctggtgtggcactttgacttgtggataaataggtttttcattgctgcagtttcaaaccttcagcttctctaatatcccctgccactgacggattatttcacacgaaccagagaggccattaggtgagaatgccttcatcttccctccctcccacctctgagcacccttctgtttccttctgagcttcttcctatttcctcctgtcgtccttctcctctctagaccctgaggggtttctcttctcttctaaggttacttcttcctactggactcctgacacccccacccccacccctgcccttgggaacttgattccatctctctctctctgtctctctgtcttgctccccgcttcttttctcatgttccatcttctttctccctcacctccttataatccacatccaaacaagtccacatctccccaaaaactccatgcctcccttttggccaaaaagaactctatagagcatcagaagaataattactaaaaatatatgtttaaaataagtggccttagtagtaagctctgagaatgagaagcttcattgtctagtaagttaatacaaattagtcgacagtcaatgatgacaagaagagagcgaaataagtttgtacttacatacctcaaaacaaaaactctctgaaaaagcagtttgtttgtctcttgacctaacaattccagcctaagaatataacaacaacaacagaaaagacaaattcatttgtagtaatggccattataaaagatggacggatattggagcatttgaagtggaaaaaaagtatacaaaattcatcttgctgtgggaccctctccccttttctagggccatatgggtatagatgcattgggggaaaaaatggctggaagaaatactttaggaatgtcctttttttttctttatatcttttgaaatttcctacataagctcgtattacattttgttggcagaaaatcagatttataaccatccgtcctccctcccacacaaccttcttccctcccacttggcctcaggcattgaggtttggcttggttcggtcagctctgctgggagggcccctgggactctctgtctccccgcctcgccatggtgagggttcggcagttctctcccccagtccctgcagtccctcttctctggcttctgtatctgccagttttctgttcccaccctgcgtgtttccctagtgtcttgaataatttttttttttttttgagatggagtcttgctctgtcccccaggctagagtgcagtggtgcgatctcggctcactgcaagctccgcctcccgggttcacgccattctcctgcctcagcctcccgagtagctgggactacaggggcccaccacctctgcttggacctgagacacgatgttccccagagtgctgctttcatggtggttttcttggcctgacacctgtgagtgatcagactgggaaagaggattccctttcccagtccttcgtcctgcaagtggctggctctggtgtagacgggggtgtcataggtagcctgccacacagggtggctcctctgttcgcctcctgttttccctggtcatggtgggctccctgaggaatcacttcccctcttgtctgtgttggtgtcctagcttaggtggccccttttcctgctgttctcaactttggtagcaccttggcaccatctggggagctttgtagtcctgaggcatgggttccccctagcagttttaatgtcaccaattgggtggaagccaggcctgggagtctagaagctcccagctgagtctgctggctgctacactgaggaccttgtctcctgtctgtgtcgtgcctcgttgcagatggtcacacccatagagcagcccgtgcctagagtcctgggccttggggctcagaatggggccaggccttcctgctgagccgccccagtgacacaggcactgattggccactggagaagcgggagtgaatggcaacaaggccaagtgggaagcctgtgtctgcactgaccaccgtgccccaggccggcctagcccaaagagacctcctgctttgacttttccttactgggctgtgcctaccttgtgaaaactccagtaaaattaatccaatggctgcttggccagacagtcaggacacatttcgtgagccctggtctgggctcagaggtttggagtccacagctgggccttgatcttctttccccagtgacgtcctcaggctggggtgtggcaagtttggagaggatggggaccctcactctgtggcccaaatagagcaatagggcctttttcttctgcttcagattatctattctcacaaagggaacaggcatccaaaaacctcacagaacagcattaggaaatcaggaattgcagccaaaggactcttgtcctctgtgtgaggctgagtcggacttccgtgactcatggttctgttattctgagtgtttgagactattaaggaaattgaatttagagtgtcgtgatttgtgagaacaatgaaatcggctgttcatattcctgtagcgtcagcagcagatgagatgggaggtgttgtctttcaggcagacaattgggagcaggctattgccttgtgcaggtgtcttgtaagggctgaggaaagcttcttgaggtctgagcagtagctgagaggtctgcagatcccctgcctcagtagagggacccatcagcaactgccagtcctgggccagagccggcgtcagccgtacaccgcatggatcctgagactcccgtgtgcttttgcagccctgagattccatgtgcttagtctccttctgttcaccccttaccagatattcccggggcacatgctggagtgcctgtcctttcttcttgcatcaagtgtgtggtggcaaatgaggaagggattttcgtattctcctcgtgtgcattccagccagggaggccaatgaacaggaaatgctcatgaaaaaagtcagatggggcaggtgacatacaggtaattaacaccatgggaacctataatggagaatgacagagaatgacttttatatttggtggctggggaacatttttaaagagatggtgtctaaactgagagctgaagatatgagtggtgagaaggggccagggaggcaaaggtcggggacaatcgcctggtacagggagactaaggagagattgagcatggtgttttcagagaacctcggggtggcccgagtggttttgcaatccaggaaaggagtttgggacatgttctctgtgcgttgggaagccattgaaaggctgtaatcaggacaatacgtgatctggtttgctttagaaagatcttgagtgagtaaatagatgagtgagtagtgagtgagagaggcttagacaccagaagagctcatgccaccgacatgcagccatgggcacttggtggttctgtttgccctgcccagctcatgtgctcataggtgaagtttttgccatcagcagtgatcattaaacagtgagatgggtaattgtagcgagggtattttctctgttggtcctagattgcctagaatcctgatagaaagaatagttttccttgaacttacaattcagcaaatcctctgtagctattttttttgtactgtttgaaggatgtactatttatggactgcaaaacaatggattctaatccgagctggagataaaacatgacgggggcataaaacatttaagaagcacacaggaggtacaacaaagcattatgcaacagcttcttcaggcaaatgtgcacattttgcatctaggagcaggtgagaaaagtgacacagagcagaattgtcctaatatataaacctcaggtggtattatgaaagtaaatactatattcagtctttaggcaaaaccatcagtactgatttttgcccatgaatgcaattctgtcttcctgatgtgttggaactacccccaaacaaatgccaaatgtgagattgaaaattaaatttatagggccctaagctgtttggaactgtttttaagatgagagctgttccacctaatagttgctataggaataagctggcaggatgaggaaaacccaagaatgccagttagcaggagaagatatcggagtttctgttaggcaaacacagggaggaaatatggagatggtattatctgcagcactgagaatcacagcctctagagacaggagtcaaagtcactcagaacctcaatgcccgggcccttgaggcagcctgtggcccagggcaggtgcccctcctgctgctggccttggaggggtggcctgagaacaggggaggttttacacacctttcccactgcagcctgtgccatcgtcatattctgcagggtgtggacacaagttagaagcaagacaaagttggctggccctgagcttgcccttgggtttgagacttgatcaggtgccagtatctctatggagaactgtgagtacagttcttgctgtctttgttgttggatggcgtcccctttaagtgtttagtcctgttgtctgggcagccttgtgctgagggacccattgctgagcagagtgtgcccagttctcagcagatagaatgagagcccctccaccatctcacgggaagctcccctgctggagcccacttgggttcttgccatgtggcttctgtgctcctggtgaatgtatagctcctgtctctctagggtcatcttactggctgctctgaggttttcagaccacagagacaggagtagagctgtctgctgccatggtcaaggtgaggcccatgcctgtggtcattccctctgtccccaacttggggacagtgtcaacctctgctgtaactggaattccctcttggtgctttcatgtaatttttgtttctttgtggtttttgtctggatattcagaccctcagagtctggcaaaataatttgcacattagtgcttcctatgtgagttgattattttcctttctaagagtcaactagaaataaaaagtaaattaagtttttatttttattggacaaactgcacctctagcctgacatgttattataggaacttgggctttgaggagacaaatttaagtctatatataaaataactttacgagttttcatatttgcttcttatcccttgaactgagaccatatttgttaagatttctctctgaaattggccacaataaatatcttaacaaattcaggaaattcattctaagtcatcatttttgctataattcctggaccttcagattttctggttaaagttgcctcagggggaccctcagatctttatggagtttgtaaatccatcatgagagattgaatctagagtacttaacacttgaaatctagagtacttaacacaatcccgggcatcatttactggtctcaggaaatcctttgagggaacaaaaaaaaattactgctataatgaaagtctctaagctggcttattcacaaaaaaccagtgtggtgaaacaaaaaaagagcatggatttttgaaatcaagacacctggattcatacttcaattttacacctaggactgtgataacattgggcaagttacttagcttctgtttcttcatttgtgaagtgggaggatacctgctttgcagggtggttgtgaggttgacagaggctgccttaggcttttcaagctgctgtaacaaaataccgtaaacgcagtggtttaaaagcggcagcaatttatttcccacagttctagacgctggtcgtccaagatcaaggcactggcagattcgatgtctggtaaagactggcctccaggttcacagacggtgccttctcactgtgtcctcccatggtagagggggcaaggcaactctccgaggcctctttagtaagacactaatcccattcatgagggctccaccctcacgatccggtcacctccccaaaggcctcagctcctaatagcattaccttggaggttaggatttaacatatgacttttaggatgacacatacattcagtccattgcatactccaaggaatatcatgcctaacaggatggctggagagtgtagatgtttcaccactgtagtaccctccagccttcctttccacacacagccagtgtatctccctgcacgtgtcttatttgacctgtggacttaacgtgcctggtggaattgccctggctcgtcctaaggctggatgtctctgctcagatggactgggaggcagtggggatgccggggtggagatgatacctgagcctggagagcctcgcttgctctgagttgaactgcagtcggatgccctagctcatccacgtgcttctgttgtgacagcgatgctgggggtgtcttccttccattcggtggcacaggtttgatgctaggacccctctgactcagggctccaggccaatgctgcagctcagccttgaggaggcgttcccagagcatgaggaggactcatggtggaggatgctggttagtctctttctggtcggaccctcactttttgagatgatgtgacatctttcctgtagtcacaactacattcaactctaaaaccattttaatttttcattttcccctgtttggggaattgtaatcccatgggtgtatggatattatccagagacatgaaacatggagtttgggtttgcagaggacaaggaagctatgagataagggagaacagaatgaagtcacaccccacacagatgcccacagattatgtgctgcagtgagtccttaatgtcctggaatcggtgacacaccaaggatggctttcaagagctttcttgagccctttatccaaatctctgcagcccctccctgaacttcgttagtttctagatcagtttacttcctaagtaacctagcacacttgtgtaagaccagctgagcttcccagatgatccctgaacgtcacggctcctgaccgttcctctgaggacacttcctggaagtttttgtgcaaaaccattattcttcccaccttaaggcaggcatgggtggtcacgtgtcagtccagcctgctgtgctcttcctgtgcagaaactcttgcctggttacacttggcgacttctctttgtaaacaaaggtgtgagtgtccttaacacctcacagttgacggactggctgcgttagctcttcctttgttagtttctgattgccagtgaaggagaacatcttctatatgtttttccctgtatcagttaggatttgctgtataacagaaacccaaaacttagaggcttaaaataatacctttttatttaactcactgttgtgtgtgttggctggggttactggggcagcaaggatggcctgggttcctctccacatggtctcttatatcccccaaaggctagcctgggcgtcttcatgtggtggactgaaggtcccagtaagcaacaagaaaaggcagactccaacgtgcaagcgctttttaaacctccatctgcatcataattgttgttgtctcattagccaaaggaagtcacagggctgccaaatctagaggcaaccttggatggaatattccaagggcctggatccagggaacatgaatcaattggaggctgttactctacaatccaccacaaagtccactgcctgttttcttttgattgttgatcttttatattaggaggagtttttaaaatatattctggatattaattctttcattgctatatatgttgattcagatgaataggagttcttacttttaataaacaaggtcacttctctcaatctttttcttttctgatgtgctcattttggctattgttttaaaaatcttccccacccttgaagccatacagatattcttcttattgtttcctgaaagttttatggttttgcctctcatgattatgtgttatcgctctcatttttttccttttggtaggataattaagaagtgtttttattaggtaagctccattttctcactgcatcaaagtcatttatgcaggcctgctctgcaagtggcattttccaagtggaattaaatggatgttactaccctgtagttaattccagtctaagacaattgcaatgcagacagaaaccttgagacattaattgaccaaacatgtatattaaataggtttgaatattcaagtgcaagcaaataattagtacacttggtgagtgaagagaaaaatgaagtactgcatttctttcctttccttctttccttgcctccttcttttctttcttcctttccttctttccttccttctctctctctctctttctcttctttctgtctttctctttctgtctctctttctctttcgttttctctctttctctcttttctccttttcgttttcctttttcctttcctttttcctttcctttcctgtcctttcctgtcctgtcctgtcctgtcctgtcctgtcctgtcctgtcctgtcttgctctgtcacccaggctgggatgcagcctccaactcctgggcctaagtgatcctcccacctcagcctcctgagtagctgggactataggtgcatgccaccatgcccagctaatttgtaattttgtgtagagaccacagctcactatgttgcctaggctggtcttaaactcctggcttcaagcaatttccctgtcttggcctctcaaaaaaggattgattacaggtgtgggccaccacacctggccaagaactacactcgttaacttcagctaagcaactcccccccgactcctaccctgttctttcttcaggtttctgttgaaaagttatttggtaaaagaagagggcctgagcagtgattcttaagatggagggaaggaaacctaacacataatctttgcaaaaaatccccgagcaagttggtattattgccatgactacatgaggaaaccaaagctcagaggatctggagaattgttgagcaaggaacccttccctcctgcaccagatctctctctctttctctctttctctttctttctttctttctttctttctttctttctttctttcattctttctttttctttctttctttccttccttccttccttccttccttccttccttccttccttccttccttcctttcctttctttctttttctttctttctttctctttctttctctctctctttctctgtttctctctttctttctttctttcttgacagagtcttgctgtgtcatcaaggctggagtacagtggtgcgatctcagctcactgcaagctccgcaagctccgccttccaggttcacgccattctcctgcctcagcctcctgagtagctgggactacaggcgcccgccaccgcgcccggctaattttttgttttatttatttattttttaatttttttattttttagtagagacggggtttcactgtgttagccaggatggtctcgatctcctgacctcatgatccacctgccttggcctcccaaagtgctgggattacaggcgtgagccaccgcgcccggcctgcaccagatctctaccaaattttaagtcagtgaaatataaatgaaaacttgttatttttaccatgactgacatcagtgtttttgagggcaaaacagtaggtgttcctttttttttttttttgtctaattagaattcttgtttttatctgtccttaaggtttttctctgtctttaaggtttttctccactcctaggaatgttccctaaggttttgatataattcaggaatttgtatttagggaaaggcaactgaaccaagttacgagaatgtttagaactttggaagccctggggaagacatctcgcccattgctggttggacagagccaacgtgggggtttctaaacatgcacaagctaacagtctccatcagctctgaattcacttctgagcttagcaatgtaagcttgtattatatacaacttcgtttcttcatgaaacaatcatcataataaattttgatatactcggaaaacttaccaggtttaaatatttattattattattaaaataaatggaataataatggactggattttaaaggatctagaatttgaccgtttttctttttcaaaacatgataaatacagaaaaacctttaacaaaataataacagtaataataataataatagtggtatgtttcctgggctaaatttagaaaactattgagtatgaggcaaatatggaaaacatatttatatcaaaggaggacctagaagcaaactaccataacttgccaaattcaacttctatgtttgttataatttagtaattagctattttagaaaaaaaaagtgcttcaatagggaattaggattttcagaattttgaagccctgggaaataattatatccagtgctgtttaggtagaacaaaaaatcaaatcacttacctggagtaaatccaaaaaagtgaaaccattttaaaaattatctttttaaatttctaaattaacgttgtttaggcatatacattgcattctgtatagctttttttttcaaattattaatatttttatttatttattttttttgagattgagtctcactctgtcgcccaggctggagtgcagtggcatgatctcggctcatggcaacctctgcctcctaggttcaagtgattcccctgcctcagcctcccacagtagctgggattacaggcatctgccaccatgcctggctaatttttttatttttagtagagatggggtttcaccatgttggccaggctggtctcgaactccttaccttgggttatccacccgcctcagcctcccaaagtgctgggattaattacaggcgtgagccaccatgcccggcccaaattatctttaacaaagaattagagagatgcaagacacccggcctgccgcgggagcatgagggagtctgtgcattcctttccaaggcatctgtgagtgcatggagtagacaccatgagcaaagctcaccctcccgagttgaaaaaatctatggacaagaagttgtcattgaaattaaatggtggcagacatgtccaaggaatattgtggtcatttggtccctttatgaatcttgtgatagatgaatgtgtggagatggcgactggtgggcaacagaacaatattggaatggtggtaataggaaatagtatcatcatgttagaagccttggaacgagtataaataatggctgttcagcagagaaacccatgtcctctcttcataggttctattttactatgatgtaaaaattaggtcgtgtacattttcatattagactttttgttaaataaacttttgtaatagtcaaaaaaagaattagataatactaaaaaataccaaatatttaatatttttaataccaattttctaatccctttaaagtacataatgagttttaagaggatgggttccagggttctagactttgagttctcaaccttatgttcttaaatcggcaaaagtaccccccaaataaaacaagataaaacttttactgaacacaatggctcacgactataatcccaccactttgggaggccaaggtaggaggatggatcacttgagctaaggagttagagatcagcctgggcaacatatagagatgccatctctacaaaaaatacaaatagctgagtggggtgtcacaggcctatagtctcagctactcaggaggctgaggttggaggatggattgcttaagcctgggaggcagaggttgcagtgaaccaagattgcaccactgcgctccagcccaggtgacacagtgagaccctgtctcagaggagaaaaaaaaaaaaaactttcaacattataatttaaaaagatgttttaggcttaatttagaaagtttacattgttcaacagaagccgggtttatttttagaggaatagttggatgcaaactctcaaaattttctgaacttaatgtttacttctgaaactgcttcctcaggcttgttttataagctttgtctttttacaggccttcagttttagctttatcatgggttgatcagccgtcctggtgttcctgggactgaggagtttcttgggatgtgggactctcagtgctaaaaccagggatatttcaggcaaactagaatgacagaatgagttaagatggattatgtcctgataaacccatcaatagttggaagtatcataagttgaaaacgcatgtaatacaccaaacctacagaacctcatagctcagcctagcctactttaaatgtactcagaacaatatacattaggctggctaatgtaatcagcctacagttgggctgaatcatgtaacacaaagcctgttgtataataaagtgttgaatatctgtgtcatttacctaatactgtcttgaaagtgaaaaacactggttatataggtatgtgaagtacagtttgggtattgtattgtaccatcataaagtagaaaaatcctaagtcagcccatcgtaagtaggggactgactgtagtcaatcaccctattcttcttgaacctcaaaaagcaaaatccatcagtttaaatgtagacccacatgtgtagcctttactttttttttctttttttttatttaagagctagagtcttgctctgttgcccaggctggagtgcagtggtgcgatctcaggtcactgcaacctccacctcacgagttcaagtgattctcctgcctcagccttctgagtagctgggattacagctacgtgccaccatgcctggctagtttttgtatttttagtagagatggggtttcacaaggctggtcttgaactcctgacctgaagtgatccgcctgcctcagcctcccaaagtgctgggattgcaggcatgagccactgcgcccggcctagcctttaaatttgattaaggtgctttgattagtttatttccttgggaggcagaagtgtttacaaagaagaggccccaggataggctgtgtccatgtggtttcaggacgtgggcgctgctttccgggtgggctggtgagggcattttttgctgcccagctctcatgtttcccaggcttgctatttgttttctaatccaggcaacagaaataccacttgtgtccatgattttcatgctggatctaagatgttgaggcagcaaattcttattctgactaatttaacagtctttcggtttagcctgtgcttggggctgtgcttagaattttgataaaaatggttgtatctgggtcatttggaaaggaatttggctgtctggaaaatagaacatataatagaacaggtggttattaaagcaccaggccaagtggagaccatgatttctctttgatttagatgcaaagattgctatataggttgacacacaaagatttataatttgtaatttaagaaaataattgttcagggagcagaaaccagaaagtaatgtatgagtattttttcttgaactgcattttcttctttctaaaagcatggaagtctttaattccccttccacagctcttaaggctgtcaaatgtattgggaatggggcctggcccctgagatgtgtaggttatacatcatacaactcaggggccaggcaccattcacatcacatttatcctagatttgtcttgaaggggtgctttttctgacccacatgagaatttccctgggctagtggcagccagcatgactgcctcaccaacccctctagcaaggactcttagaggaaaacatgaagaaaatcacatttttcttctgttagcattttatagacttcttcactccactccagacctttggatgtctgacctgaggacaatcaatatgtttttctagagtttttagcacgcagcagcatagtggcttagagtgcagaccaaggagtcagtgccataattttctacctgtataatcctgtgcaagttggcctctctgtgcctcagtttccccatctgtaaaatgggggcagcacattcctcattggactgttggggaggttaaatggattaatgctgtaaagtacttagaatagggcctgacacattgcatgtaaatgttaccagcctcgttcagctttgcctctgacactgagctgatgtacctgggtctggcaatacaacattgtagatgctgattaaaacttgaggcacatgtgaagaaaccatgactattcccatgaccccgtgagaaggttggtcaaatagtttctttgtcttctgctgggtttcacttcctgctgtctcagctgtaccccctaatgttggtgtgtggttgtctctttctgtgccagccgctcccatgagaggagcctctcattgccgggactttagtggctcgggacagtgccccatgagcgctccagttaagccaacagatgggtacttctaggctggaggcactgcctcgccagggcagtatctgctctctgtggatgtccgaattctcacgggtgggctcagcgagacagtacgctccatgtgacccactctggtctcaaaagctagaaaaatgctctggaaggatattgaacacctatgtggggctctgtggttcaggttaggttactccattagatcatttgtatctggaaagaacagggatggctccaacactgtacaagcctgcagtcctcctaaggctaaaagacacaaggtggtacccgtgtcatggtggtgggaggttaaagattagtgtttgtgtgtgtgtgtctgtgtgtgtacatgtgcacgtgtgcaactcttgctttgtgtgtgtggcatttcactttcctaatcaatttaggcaacctgttggggcttcggaatagtgcatctaggttggaagtatctcccagtgaatgggtcacactgtcacactgggcttccagcagaccccataccacccaccggtgaaacttgagtaaagctactctaagaatacagagcattggagaagtgctttattcggttaactttaccaccaccagggaatgtctgggttgttctcaatgatcagtatgaaggtctgtggggttgtggacacattcagggttggactggggttcgtattagtcagccgactgggtatctttattcacagaagaggcaaaattagcaaataaccccatcaaaatcatcttgatagttgttctcaccaaggttgctatcacctctataattatgaaaatgttttatgaggtaggcttgggaatttgaacaccttttgagaactgttgggaacaaccttctcagttaagtaaagaaactacttaccagaaaacatgtggaggacactggggtgataattcatggtcatttccgataagctacttctagggccagaatctctgctgaatctcagcttcctgatttaatgaagacaaggaaatgaaaccgccctgccgactgtttgtgcttttaataggccgagttttcagaaagagaagacagttaaattagttttcctttttgcccttttcattctccctgcttctgtcctgcagatcaaggcctttgaaaggaaggggaagaggaagtgttttcttgcttagtgaataggatgcacctgtcccctgaggaagattccctgtgtgtgcttgtatgtaaatgtacatactctcttactgtcctctttttcctcctcacaaatgtaagcctgtatgtgcttcatattaatacttggcattcccatgagcctgcaaagtctggagggagaggccaggcccgtgcttctggccgctgtgacccagcacctggcggaggccctcactgagtcctgtcccctgagtggaggtgaaaggtagacaaggaagaccccacagttggagagcctgccatggacaggtcgcgcattgtttcacttgggcctggttgagcgtattactgggagtgggggaagttgacgctgtgacgtagtcctggggcgagcttggaaggtgctctgggcttgtcagttgacagtgtgtcattagggatatgagcggcaatgcgatgtcctcccctgcaaggaaggagatgtttcagacttaccattgactgaaacagggagacgagtgctctctcatggaaacaggggagatttgagatcagtcacaaacacttaccaaggcccaggttcagtccactcctggagctttgaggggctagtgtgtaaagggcacagaagcccttttgctaggtgcactggcctgagagcttcgaggggatttgccaatgggattgtgccacaatttttattactttttccctagtcttcgtggtctaagttttgttttctcaatctttcttttctcatcttccttgtgtggagttaacttttaatcagggaaagggaatacatcgagctattgatgaatgaatcactggagaaaacagtgaagtgggatttttatttcagggtctcttaggtggcagtgccgggtgacaggtgggggtgtcccttgtcttccattgtcccggagactaaccatcagcctctacctaattgaatggcatttttatgtgtttttcatgaacggtggtggatggagatgtgtggaggactagcagctcttcatgctggagggagttattccgcctctgctctcagacagcctgtgaccaggcacgggtcacattgctgccctggacttgcactgtatggcatttgaatgtcatgtaggggcaccgtgtatttcagtggctgtgtctaggcagcccgaaagccactgaatccctcatgtccactctgcagccgacattcactcagcatcctggaaaagtgcccactggggcaggagcttctcttgctcatgtggacatgacggtaagtccttcttggagaggcagcatcaagtcatgttgttcgttctgtggccaggaggtacaaagtcagctgtttctgcttttaagtgatgtgggcttaaggaagagggaaggaggaatgaaggaaagaaaggaattgaggagggaatgaaagaaggagagggagggagggagaggaagggaaggagggagaggaagggaaggagggaaggaagggaggaagggacggagggagggaggaagaagccccatggctttcttgtaaatagcagctgccctgaagtctgtgaagggcacaccaagagtctggctgggaggttgtcagctaggaaactgtggcccaagttcgtggtgagtgaggagttactttcttcccttgaccactggagcaggatagactctgcctgccacccatcccatgaagaagactttccttctgagtgccttggtttgcgcttcagggaagccactgacacgttcattacctgtttcctgaagtagacagttagagctccctgtctcagtgtccaaaaaaaccaaggggccccaagtgcagaaacaagggctgaaaatgtatgttttacggacaggagacagccagcctgtttaagtggaggcttttttggaaaccccactttcccagtgagtcacagtaaacacagacagagcacactgcttctctgacaccagggccagggctgtcctgggctcagaatgaattagaccagcttgccttttgtgttcaccattctagcatttctttccctgcttgattgtcaccacatgtgcacacacatacccacatacctgtgcacacatgtacactttcttatttgctgaccctcacagccctgccatccctgggctaccaggcagactttctgatctggagcttaaccggcccagacattggaaacaccaagcaactggtagctggtaagacttttaccccatcaacgaggcttacgaaagagtaaacttaccttaataatgcctagtggccaggtttccaggagtgggggacagcctggcgctgtttgtaggggctgaagggaatgtttactgaggggatcctgatgcagtggccgctgtgacagccagtcaggaggtcttgtccccattctaaagagcgagaaactgcagagttgagaggaccacaaaccctagtgcagccgggttttctgcaggggtctctacagctcagagcctctaggctttgtcacctcctgggtattggaggcttcctcgggccctcagcacagcccacacctaccagggccaatccaatcatgtaggctggccagggcggtgagcctccgaacaatgtatgggtggtgccaccaatccttgtcctcactaggaatccagtcagtcatcccgcaattccccaggccgggccacagctggctgtgctcctaacatccctgcactgaccagcaggtcaccggtacctctaggagcctgactgtgtggcagccgtgtctgagtgatgactgccagaaagttctggtttgttattcagacatataatacgtgctgctttgaagacagtggcctgcactgctgttgtccttcctaataggggtagggtcttgccaggtcagagcaggacccatccaggggcagtgacctgtgctgatgtccttggctgtgctggatttgacgagaacactctgtggtcaggggttttgcctttcagctcgagctgcagagagaccctctctgtcctgctgcttccccagattctgcccacggggcatccgcatgccctctctagctgggtgaactatgtggggtcagctcactgtgtaggctgcctcgggaaggagggagagccttgtgctgccagggccctagtttccatttggcttcatcagagagtttctgacacatacctactgccagatcacatgtaatagctgcaacatgccacgcggcttgtggctgaagttacttacaaaagccgggttgaggaatccataaagtgtaggcttctctggccttcatgggtcggattaaagggtgtcctggccctgaggagcacccagacctgcagctgctgctggctcctgaacaactggctctgagtgtgcagaggcctggctctgacagttgagcctacctgaagccctctgagaccaccatccagagccggaggcatcctacatacctgcatgcaaggggaggctgggcctccaggtctactctgttgtgatttctgctgggttgtgtgacggtggtgcattggctattgtgggcctgttggtggactagagtccttgattttccttctgtgcaaagtcaggactctccggggcccttcatgccttaacatcccaagaggcttgttttgttattttcttccacaatgccctggagttaccatgtttgggcggcatgttatttatggagaagttggtgacagggagaccctgatgtaacttgaattgtgataatgtctatacttgctctcacggcctacggaagaagaatttgtttttcttgatttggttcttttcacttctttttcttcatggaggcttcacgtaggtgcatgtggagggagctttattcagacaagtttccttgacatctctgggaggtctctgtttgtctggctctgagagcatctggtgtttggacagcctctgggccgggcgctgtggggatggctctggaaactgtcagtcatgtgtgtgctacaccgtgcacaacaggggctctgcagatgatatccatgttctcagacgcccaggggttttctttgcttaggttctcttttcttctccggccagagatatcttttccaagtagtaattgtaatttttttggtggagggttatttgtgatgtttatctcaaccctgggaatacctttttgagagtagagaggctctctgggatcttttcattttctaaattctcagtgtatttagggaataaatgcattcccgagactttcctggcggctgttgataagcctgcagtgcactactgatggttggcagccctgtgatttaccgtcctctccctagtggaaaaccatgcaaactgacgcctaaacccaaggcgccatgcacagtcactgctgatcccaagtgctaggcaaggcccaggtgaggtgagtgagggagacctgtgacccgaggtcagggagctgcatgtgcccttccaggaaccaccaaagcaggagagcaggtgcagttggcttggatgggttcagggccagagaaaggtggagaaagcatctgcctcccagtggctgtatctgggttttaattccagttccatacttaccctctgtggagcttagcactttcacttgtagcgtgggcacagggacaccttggtcataggcaagagggctcccgatcttgtatgtggagtgcctgatgcaggatctgactggtgaggtggcccatggctgagagctgacaggctgtccagggccaatggaggcccatgggagaagcggcctgcagagggtgaagagaagacttgcaatcttatggcctgatactgtccatgggcaatccagggacagaaggcacggaaacttcaggtgaccctagcgtgtgtctgaaccaagttcctaagtgcatggtttcaggggagggacttcttcctcccctacagagagtaatggaaggtaaatggttgaagccaggcaggcaggtgacttcagaaccccatcctgcctctgctgtgagaggaaggccactctgtttacaagcagtgaggctggactgtttgaggtgttctcagccccatgtgcccttctctggatggagagcctttccctccctttagagggcactgtgtctgcaggaaggaggtcagtagcatgagcacttggcctgaagtgtcttacacgggtccatttctgccaagacgcccaatgggggcccaacagccaggcccgtgagctagccttctgttgtgtggacacatcaacatttctggctctgtcacacaggtatggtcagggccctttgtagttgcataggtgtaaagcgagggccctggctgatggctcttcctgtcaagcagaacaaagcaatgatgtggaggtgattgtcccctccccagggctccaggaagccttgatccgcacactgtgctgaacagcacacagcaagagctctagttaatcatgaggattaaattgtgtttgttttcattgtaattacagcagagcagtaaaatgtgcagtctgtggagctggacaggcagaggtcaaggatgtttgcttcttggctttggaggtgtcagacgtgtgtgaaatatgctcagcctcccacctgtgtgtgcagcagccaggcacctcccatctcccagggacaaacacaaacaagtgcattcgaagggaagggtgtgcccagaaagaagtggcatggggctgcaggtggtgttcagtgttcattgagactctgatggctgtgtgctggccaggccccatgacgacaggtaaagcttaggactcttattgaattgggtgtgtatttaaaatttggctcattgagaatcagtgtaatcggcaggcatttcaagcctttgtcatggatttatacagtgtttgggaggtgggtcaccctactggtcagcctccccaccccttcacttatagtagggaaactgaggcttgccttttttttttaaatttattaattgggctctctgctgatacgagacatgttgatgcattcagtgtggtgtgtattaagatctttactggatgtgtagcattccacttcattacatcagaggaagggccacaaagctctataaaaccaggtcccctaagagtggctagagcaggagacaggtcggtggcccggctgctgatgcaccagccccaacggtgccagcaagcatgagcaagcccacaggtgccctcggcctcagggcaggaaagccctgggaaatgcttattattacagtgctggggtctttcctgttatggttacagttgtatttgtctaacagtcttatttaaagaagaccaacatcatgattctgcatttaaccatctgaggcttgaaagcttggagagaaaccagttgtctaagtggtttgtaaatgggagagataaatgtctcgagtaaccacggtggaaaagcaccaggagggtggtgctttcactgtacctgggggcagccatgctgattgcaggagctttggggttactgccttcaaactctgctttcgatgccctgggaacctctcatggtgcctgtggggtacccaagagcccataggacagtgtccggaggccccactctctgcagccaggtaaacctacccaggccctttccttgcggcctcatccttcaaaggttttcttgttttattattttacgtaatgttgtttcttttaaagaagctgagaaatgaaagagcaattgtatgtctacaacttttgtgatattaaccttattttgaatttctggtttaccccatttgtgttggtgcattcaagttattatcaggagataattctttatccgcaaatagctttgttctcacttacctccttggttccattattggaaaatatattacatttatatatgtaatgggcccaatgataaaattatatttttattttcatacaagactttcttttttcttttttatttttttgagacagagtcttcctctgttgtccaggctggagtgcagtggcatgatcttggctcactgcaacctttgcctcccgggttccagcaactcttctgtctcagcctcccacgtagctgggagtacaggtgcccgccaccacacctggctcgttttttgtatttttttttgtatttttggtagagacagggtttcaccatattggccaggctggtctcgaactcctgaccttaggtaattcacccacctcggcctcccaaagggctgggattataggcgtgagccaccacgcccagccgcaatcactttgttaaatgagttaagaacggcagagacatgtgcattcatactatcttttataatgacccggctgtctttactagtgctctttgtcattttatgttggtttaaattattatctgtggtcacttgattttagcctaaaaaagctttcgttgctattttctataaggtgggtagatcaactagcatcagattttctcagtttttgtatatctggaatgtgtttattttgtctttattttttataggtagcttttctggttgtaaaattcttgattgacagccttcaatcaaataagtaatgaaatagtagctagaatatggagactttaaaatgtcctctgtggattagggggctgatgcatacatagaaagattgattctctcagttttattcctggggagccaggtagagaatttgcttttaggaggtggattttcattccttgagcaaagctaatagatgaacttagctcattctgccaggacagtctgtcagtggagagactgtactattaatagaaaggaatgtgaggccgggtgcggtggctcacgcctgtaatcccagcactttgggaggccgaggtgggcagatcatgaggtcaggagattgagatagacctggctaacactgtgaaatgccgtctctactaaaaaaatacaaaaaattagctgggcatggtggcgggagcctgtagtccccagctgctcgggaggctgaggcaggagaatggtgtgaacccaggagacggagcttgcagtgagccaagatcgtgccactgcactccagcctgggcaacagaacgagtctccatctcaaaaagaaagaaaggaatgagagctggacaagtcattccctggtcaggacactccagaagccctacatggtttgcaaaaccatctgggctgttccagctcctccctgtctttaagctacagatctcagtctgtgggtgctacctgtccacctccccaggatccacctcgagtctgtgggtgccccccatccacctccccaggatccaccccaagtctgtgtgtgctccccgttcacctccccaggatccactccgagtctgtgggtgctccctgtccacctccccaggatccacctcgagtctgtgggtgcccccatccacctccacaggatccaccccaagtctgtgtgtgctccccgttcacctccccaggatccactccgagtctgtgggtgctccccgtccacctccccaggatccacctcgagtctgtgggtgccccccatccacctccccacgatccaccccaagtctgtgtgtgctccccatctacctccctatatgtcctgctgggcttcttacccttagaggtgctcgatagatagaagatggcaaagtgaatcaagtctcagggccaaagccaggctttttgtaagatctcaaggcacgatttaaaaccatgtgcatgagctgacagttggatgtcaggaggtcaggagtctaggtggtggtgaattttacaacagagatgataacagcccctcccactgagcccagtggatgctagatgtttccgtaagggctttctgtgtatccttagccagtgcccttcccaggcccactgggcgggcatctcattcttctgagggccgtggagtctggccatcacctaccgtgcatgccgcaccctcctgaggctttctggagtgtgctattttccacttcctgttggacagacatcttaaacatccttatgtttcccagacatctcagtctgccttcctagcataattcttcttgtaagaaatgtaggattttgtgggtggcagggggactagggaacatgcatcagagatagccgcatgctctgtcttagaggcatcatcagcctggggaacctggccagctcttgtggaccgcagtctaattggcctgctccctgcagagtgagtgggctgcttagactttgcccacttgaggcgttgcgaaataggatggtgtgtgttttatttttttttccttgttatttaagaaggaacattgaagagagccaggagggttcctagtggaaaggaaggcagggagaacagctgcacattaggattaaagggccaaggcaggacaaggccaggggagctctgagggcagctcgtgggctgtgttcgccaactgctggagatgggtgagatgcggaaaacaagcaaaatactgcaaaatggaagaaaaattgacctttcctgttatccattctcctcacagtttatcagatggtggaaggaaacactgtaattctagaaataagccccaccctgacagtgagcccccacctcccagcgtggaaataacccattcagggcagtggcaccctgctgcccacccttaggctgctataggccagtataggctggggtccctgcaagcccaggtctccttcagggcaggtgtggctcttcctctcccagatgactcagaaagccccccaggggcctgcatgggtcctgccaggtggccaacgctgaaacagaatgtgtctttgatttgggttgaatttatagccacaggtcatctgattatagtcagaaactctgaagggaagttgcagggtttttatcaataaaaaatgtttaatttaaaaaaagagattggcacataaaagcttttaatatgcagggttgcaagggcagagagaaataatgagaggtcctgggtgggtcaagggggtggacaccactgagctggggcattgagaccctgccagcaccagctgtgcccagtctgaagtttcagagattgaaggaaacttgaaattacccaccgagccctggagaaatccttgggagcccagacatttgcttatgtgcgcatgtgtgtcatgtgcatgtgtgtgtattgtgtatatatgtgtattcggtgtgttgtatgtgcatgtgtgctgtgtgtgttgtgtatggtatgtgtgttgtgcgtgcatgtgtgtgttgtgtgtatgtgtattcagtgtgttgtaggtgcatgtgtgctgtgtgtgttgtgtatggtgtgtgttgtgcgtgcatgtgtgtgttgtgtgttgtgtgcatatgtatgttgtgtgtatgtgtattcagtgtgttgtgtgtgctgtgtgtgttgtgcgtgcatgtgttatttgcatgtttgtgttgtgtgtatgtgttgtgtgtgtgttgtatggtgtgtgtgttgtgtgtgtatgtatgtatacacaggatccactctgcatctgacaagaggctgccccaagcaggagtgtcctccgatacaacaagactcgcaggaacaagtctgaggacttgacaagggacacctatgtttgggagtggtcccagaacggtatccttaatctgccccttcactgccttcaactctcattgttctcctcaatacagtgaagtccttaaaccactggtgacaccagggacgttttgtgcctgatgcccgtcaccgagaccttggagtgcagagcagggctcccctcagggcttagctcagcagagtcctcagcacaaagggcagctcaggagccagtgctcagccacagattgggaaggcttctaagccgtagtcagtgggcagtgacacggcccacgcttgcttcattaacagcctaacaagagacaggggtgagcgtgtgcccactcgcacatgcatgagagagccagggagggagtcacctcatgttatttaatcaccctccaaatattcagagctggagaccactgctgcagaccgcctcccactaaggacaagctgatgtatgtccctgagcaggagaggatgtctgtgagctggcttatttacaaatacgtgtaagtggcagttcttaatttgcaaatctgtgtctttataagacttgaagaacaaacaataatacctgcagacagaggtggataaaagcattgctcagtactgagatacattatcagtgaaggcaccctgaatgcctctggtctctgatgggtatcgctcagtaatcagccagggaggtggtcaaacaggatgggagttgcttccgatcggtgatttccccatgtgtgcttaggtttcgtcatattttttaggaatctcccttcctctgaataggaagtgcatgtaaaggcacacaatggaaccagacatagcttcctgttaggtctgtgggaggtcatggctggtgaaagggcaggatccaaacacaagcataccaggggaagaaaacccaaaaagaccccaaaggtgatcactgtgcgctttgtacaagtgctgagcttgcccgaagaaagaaagagacgcaaaagagaagcagcactgaggaagcctggctcccgggctgcttttcataaagacagagtcagtgttgctgagacacaggtggaaagtctttgtgcttgcttctttgatcagccccactcccttccaacagagcctatcaagtttgcttcctaatgagggcccccgagtgccggctgtgatgggtggaccaggctgagggagggccgggagccaggggagccactcccagctgccacccctgaggtctgggaggcaggagccccacccgtgatcccctttcccttcttttactctcccttccctgtttctcagtgcatgtcagggaagcatcagacagaacacagttctgcgtctgtccctggagcgaggccgagtcaagccctgttggggagggagaggccctgtggtcgggcaatggggccaggctcctgctggacagaggttgcttgggaggccactgaggggagaaaggagctgctgcagcacagccacactcctgggcccctggacaggacaggatgggagaggacagagcaccccagctctcagccctgctgcagttgtgcgggtgaaacggacatccccactaagggtccttggactctgtgtccagtccttgtgggtgagggggtcttccagactgtcccctaatcccacctggagcccagagaaggggccgatggggaggaaggggctgggtggctccactcacctcctttggtcgtcacttttgctgatgtttgtgatgttaaaagagatggaggggatgggcaggctagaataggtttatcttccccagtggtttctgtgtggaatggaaaaccctgagccctgcctgctgaagtgaggtgcggccccttctctgggctccaggtgggattgggggacagtctggaagaccccctcacccacaaggactggacacagagtccaaggacccttagtggggatgtccgtttcacccgcacaactgcagcagggctgagagctggggtgctctgtcctctcccatcctgtcctgtccaggggcccaggagtgtggctgcagcagctcctttctcccctcagtggcctcccaagcaacctctgtccagcaggagcctggccccattgcccgaccacagggcctctccctccccaacagggcttgactgggcctcgctccagggagaggtcccccactgaacaatttttaacttcaagatggtgcagaagcgatacacattcagtagaatctttactttgagttcctacacaatcactctatttttcactttcagggcagtgttcaataaactgcataagttatttaatactttattataaaaaaaaaaaggctttgagtctgatgatgtcgcctactataggctaatgtgcgtgttctgagcatgtttaaggtgagccaggctatgctatgaggtttgccaggttgggtgtattcaatgaatttcagacctaatgatattttcaatttatgttgggtttatcaaaatgtaaccccattataagtcaggaagcatctgtatctttttccgttttctgggggacacaaatgtctgaggaggaccttctgagccctaagacatgcccaggtgatgaggcttgaggacagctcctcccaggcacagccctttctcttgtcccgcactgtgctctgtccatggagccacgaggcacaagggccgcacgtggattttgtgctgagtggcattggaagcgtgggcatcataggcagtttccctgggggagagggaccacaggctgagattcctctccaaccttcgccctgggagcagctactgtgatagagccagattcccaagttctcattcatggtattttgaaatgacataaagggactgccaccaaacaaggcaggatagcagcagccaagatgggaaaaccttgccttccccccgggagaacagagggagcctccccacacaccgtgtaatttccagaaaacactggtgcttctccatggctctgctggccgaccacatcctcctaaccctttaagaatccagcccccctttcttctgactttaagcaccaggtagtgcttaaaagatagttgccaagccaggcgtggtggctcatgcctgtaatcccagcactttgggaggccaagtctggtggatcacttgagcccaagagttggagactagcctggccaacacggtgaaaccccatctctactaaaaataaaaaaaatagccggacatggtggcgtgtgcctagtcccagctactcaggaggctgaggcacgagatttgtttgaaccaaggaggtggaggttgcagtgaggtgagatcgtgccactgcactccagcctgggtgacagagcagccgggaggggtgaggggaactgaagatagttaccaagatacttgtgcattttaggaattgggaccaagactccagaatgttcgtgtgctcaggcatttgttcattacatcatcctcagtcccagtgtcccctcatcccctcccaggaaagcaaaacgtaactactactaataagctggttgtacagagaattcctagctgtacagaaattaatgaagccctaggaaagagaatgtgatgaaatacttaatagattgcgattgaagccactgtctgaagctgaaggaagcaggatgccgtgagcttggctgccgtggggcaggggcaccagtccctcttctctacccaaccaccctcctcccagcagtctcagcccccacctgggggtgttggaggagtgtttggattgatgatcagcaaattggggcagcatgtggcctgtcacaaggaagatctggggggtgaggatgctggttaggctggaacacctgaagcgtaaccttaaggcgagtctgtggttgcctgaggtggcaagcagccctgttggagtgccgggcatggggaggattgccattcagagtcagaaagctgcctagcgggataggcaggctcatagagtggctgtgattcctgctgtaggactggctgagggtgcctgcagctgccacagggaaggaaacatttcttcttgtttccactgcctgagctggggctctgagccactggacttaatgtggacaggagggtgagtagaacccatccattcctctgtgatcagcggtgacagcccggggcagtgtggccgtttcaggtcaaagcggacttcatcccaggaggccacgggtgcagggcatgacccagagatactgggtgctaagcagaggtatgacataggtgtcttggccccgtatctgggccacgcaggtggtgtctggagcatcctttggagaccgttcctggactgttactcctcttatgtagattgacctttctctagctggggatgttgggccaggcatacctgcccatggaaaaccaaaactgttacagacagaagtcacagtgacagagcgttggtaggatggagtggccagggaacctgtgagaggagcctgtaccgacactgcctgcctcacacagcatcaggagggagacaccagcggggccctccatggctaagtgggttctgcttctgaattgcaatttcttttatatgtttattccattttctgggtcacccctcattgaacatttactatgtgcctggtgatgtcctgagtatacattagtctaaggcggagtcagtgttgatccattccaccccagctcaagcacccagccagcgaacggggcgaagtgcaggcagagagccagaagcagtgagggtgtgtgcttggcttcctggagtatttgctaatgagcaaaacaaggtttgccggcttgaaatggaaaagcaacagggaaccaggaatgaattgctccagaaaagccctggccctgcacccaggagtctcctaccttgtttggtgtgaaatctgtaaacatctccttcctcagagacacagctcctcccaggaggaacctagagggatgtgcaaagaaaatctcaacccaaaagctcaaaactgtagagtaaaaacatttcacatttggcttttggagtaagagtttttcaacaatggatacagaccatattgctgttcactttcccgtaaatcaacgtgagactttgctgtcagccaacatgacagcagtgaacagagcccagggaacccctcaaactcaagatagtcaagttgtaactatggcatcccagccaggaccttctggagtggggaccaacaatggggtgaggccccgtgtggttcccaggatgccagaagccccatatccagatacgtggtgggtgctgcattgtcatttaggacgaagggcccccctctgccaattcactgcctgtttgcacagaaagtcgtgtgtcctcagtattggacttttgtggtatcagtattgaggcccacaatgtatctgactatctttaaaatgctgtacaaatctgaattgaatataagtatcctataactggagtattgaatgcggctagaatcatcccaaggcagaattgagattctaaccgctacgcacacacactcacagccctggatcctcctttgtgtgtgttctttcaacatggtgatggataattttcagaatggggtctttgggtacatctggtatgggtgaaccatatcttgacactgagtgacattggggtgctgccctgtcccatccctgtgtcatggccgggcctcctgcccccaccactcagggcagcccgtctgcctctggccagctgtcggagctggacttatccctccctggtctgaggaataagatgtacccttgggtcagaaccccccacagccctctgcaatgactgtctgacagcctttttcctagtaagctgcttcttgcttgtctaggtgaaatctctagcaattgcccaaccaaaaactgggtcttggagctgatggctacacatcccctgagggtacctctgaaaagcaagaccttttgaaggatggaaccctgaagagctggtgcagaagcaggactgtgcaggcaccatgagggcaagcacgaagccagctgtctgcacagacccaccagcatcccgcagctccacactgctttcctggtgtgtgggacgcagggagcccccttcgcctctaactgtgtgctgcactcacaggggccgagtagggtgtgtttcttttggtgatgatgtctacttgggctgaaggctcagagcgctcgttcctttggagaccctgctgcaggcgagtggtgagcacatgcttccgcacagacacagctgccaacggtcctcctccacaccagcgctgagttgtcatggagacaatacaggctgggctgtgtgtggtcagcagaggggcactggcccagctgggtgggtatgtgagaggatttatgaaccagcatcaatgcatctcagttaaacagcccccggtactgccgcacacgcaggacgtcaggcttggtgtgtgtgggttcccggactggtgttctgtcggcaaacgttctctaacatccctgacccggttcccttgtcatgccaagacagtttcctagcagccttaatcatgaaaggaatcacaaaggacccgtattttttccctattaagctactggaagaaattaaaacagggaaagaaaatggttacctttaaaaagttggttttaattttaccagtgggagaaagaccagtagtcaaatagaagttgtttactgagtatttcgggttgaagagatactggttcttgatgaccatctggatgatttaggatgaattttaaaatccgctgtacaggaaattaaggcagtgctcattaactaggaagatcctaggcctgtcctgagaataattgcacagtcgtctgttcagtgctgcctgccaggctgggaaggcacatgtgtttctgtggatgtatctgtggggcactcagggccctggaggcagagtcttcctgagcttgtctggaaggagtgcttcccttggtcatcccaagctccattgagccttaacgcatggatgaggggggaggcaggtctccaaggggaccctgagacccatgcctgcccccaggaggtgtgcggggctgggcggaggaggggagaagggagaactgagagcctgcagcatgtgccagtggaggaccaggtgaatgcagaccccactcactgggcacgtgtttagtgaatgcatgtgaggtgccaggtgtcttgtacagatggggagttttgtggtgggacaggcttagagtcctcctctgctagagcttatggcttcatatgatgatagacattaaacatgcgcaactgctgatggggacacacgttgtcagggacgcatgagatctatcacgttgcagggtaggagtcacatttagaaggtcatagatgtccctttcatatggtgacagggtatgcaggttgtgactgaaatccagatatgctgcttgagaccaggctcagcatacatgctgattgcttataaaggggttgcttgaagtgaaaggaaacaagtaggctgctagatgaagaatatgggctctggtgtggtaggactgggtttggtgcttgctttagggctatgtgactttctgtatggaaaatggaatactaattatgctggcaaggataatacttaccatagttctgggcttataaaagagtgccagtaatattacctcctatgtgtgattattattaacattactgctattttattatctttattgtcatgtcaaggaaaatcatttgtggtagtatgtcaaaggcaacttgtagttctggaaatcttctaggatctggatttcttagaaagttaaaaagtcattattccttggaacaaacattatggagatttgagatttcaagttcattggtcctaaacatgttatcattttttttgtatatcaaaagtgaattcctaggtgtgtgcccaaaagaattaaaaaacaggtggtcaaacaagtatacaaatgttcatagcagccctatttacacagtagcgaaaaggtgggaccagcccaagtgtctatcagtggatgagtggataaacaaaatgtggcctgtgcctgcaatggacttttattcagccatcaaaggaaatgaaattgtcatatatgctgcatcttgtgtgaacctcaaaaacattatgctcaaaaaaagccagccacaaaaggtcacatattgtatgatttcattggtatgaagtatccagaataggtaaatccatggaaacagaaagcagattggtggttgccatgggctgagaagaggcggcaatggagcagaattacttcacgggggtagggctttattttggggtgatacaaatgttctgatagatagaggtcgtggctgcataacattgtgaatgtagtaaatgccattaaattgttcactttaaaatggttaatttcatgttatatgaattttgcatcaataaaagagctagttctaagcaccatttatactgtaatatttgtagattaccataatgtaaaattgtccccaccatataaaaatgttctagatagaggtagtggctgcacaacattgtgaatgtagtaaatgccattgaattgttcactttaaaatggttaatttcctgttatatgaattttgcatcaataaaagagctagttctaagcaccatttatactgtaatatttatagattaccataatgtaaaattgtccccttagaacatctcagaacagcttccaccattaaaaaaaaagaaaatgtgttccacgcttgtctgccttattatcaccacagcaagagcctgaggttgacctttcatgaagctttgcacaatcatcatgaaatgtggtttctcgtactttgctgcatacagtgaggccccgcagaggctgccacgtgagactgatattcaccctaccctctcttgtgatccagagaagtaggagagcctagaggcacaccaggggaaatcagatcaccaggcttcagtttatatttgtgataacgttgataagttgctcagagccctgcctgttggttagtgtgatgtggcctgaggagggttccgtgaccctccattcagttggaccgacaccggaagtctgctgtaggccaaggcagcagcttaatcagggccttatttattgattctgggttgtagattgttcccgatgacctagttgactagaaagcgtcacaggaaatgtgcaagttggctgatgagcactcaaaagagtgccccgcacccgccgtgcttctgcccttttcctgccctgcctggggaacggttgcacttccaagttcaaggattagctgaggttgtctggatgcttgattagcgcgtccttttaaaaggttcattcctcatctcgctgtttgccgggtacccttcctctcccggacagccgcacctgcttccctgtgctaatgacagtttatgaagcgaggcacagtgagagggatctgaagcgttcgcggggagctggtaataggatctaggattttcccttcaaggtcggttggttttttgagtccactctaggtttatggagaggaaaattcattataatctgacattatttggctatgaccatggaatggatttatagcccacgtcatgtgcagctgggtgaggggagacgaacatgcccccatttggtctccaatcctggagaggatttcatggttcagttggcagagaggaacccagcaacccttcattcaggaggcagtgctcttcccaggaagggggatctcggacccagtgatggtagaaggcattctttggctgaacccacgagggttcgagttaggagcaggcattcaacttaagacctgagaaaacaccagcgttctcccacatcaccatatgtgtgagtctgaacgtccctggaggtggcatacgctcatgtcttagaagaagaaaaagttatttgctctagaaaagggtcacgattagatggatatgggatttgtcctttgagctaggaatggcattgatggcaaatatgtgtcccgtagtagatgtagcagctgtcactgggtgatggcctgagagtgactgtcagtccaggcccgtctgaaggctgtgactgtcctccgggacccagggagggcaagaagctttagcccaggtgtcgctgcatggaaggccttgttcaagccacttagtgatgtattttctcacctggaaagtagatgtaatagtaactggagaaaacttgtgtttcatttgtatattgtgaaactaaatggcatgcttattattgttttgccatggtgctttgggctaaggcgctggacaaatctgaactgttaccagacaaatattctaagtcagatagagaccctttttggcttgttttaaatcacattattccagcttttgtgatacctcagccttctctgttgttttgtttctagagaaaacagttttgacttacatatatatatactacctttttcctaaaaggatctaaggggccttatacaaacaatatagttaagcaagataaaataatctaaattcacatggaaaaaaaaatgagattaagagagtagagatgaccaaggttcatgtttcggggagggtgtaagaaggggagtcctgagctgggggactcggcttctccctgaaaggagcagtgggcaaatggacagaatcaacagacttccctcgagcacctgtcaaatggcaggcaccatgctctgtgctgggataaagctgaagtcagccccacgccggcggtccctcaactgtccagagccctcaggactgtaggagggggcatggggtggcaggtcagccttctgtatcttcattacgtagttagaaacagttcccagaatttcagtcgcatctgtgcctggtgtgccctgcatttcggatgtgtcacacttggcctctccctcactgtacaggaacctggatgtgactctggaatcaggatcactgaggtttgcagatgatggtttgattggattttgaaatgattattttctcagtgtcatttcatttactgctctttatgtgaccccggcctcggtgatggaaatcaactttgtgttctcaattactacgactgtataatttcataagatttagtatctcccgtgaagagtcctacttctgctaggacattgggcagctgctgcatctccgagcagtccgtggaataccaagtgacaggcgctggtccgttgaaagtgcctccctgagacttacgtgtacactgtcgttatctatcaccctgcactcctccgcgtgcgtagctcagaactgactctgaattaaacaggcagtgcttgggtttggatgtcctctcccactcagggtgcctcccattcatgaggagccccaggtgtattgtgacaacaagatcattaccacaagcgtggctgtgggtggatgtgtaggttttgggaaatgattacttggaaaattaagttcttatacctggcagtcttacctcttaaaagtggagaaacagtggccaggtagactttgctgtgaattacaagggcatttcttctgctgaaaggcatttcaggccgggtgtggtggctcacgcctataatcccaacattttgggaggctgaggtgagaggatcagttgaggccaggagttagagatcagcctgggcaacaaggagaccctgtctctaacaaaaaaaaaaaaaaaaaaaagccaggcatagtgtcatgcacctatagtcccagctactcagaaggctgaggtgggaggatggcttgagcccaggaggtctaggctgcagtgagccatgattgtgccactgcagtccagcctgagtgatagagcaagacccaatcttaaaaaaaaaaaaatcaatttcagtaattcaccaggactattttctctgcactcctttgtggaggatgtttccctgagcccacggtaggcactttatcggcagggccccgtgcttcagccaccctggtgcacacatagcagcaggctggtgcccgtaatgggggtgggcccaggggcatcccagtggggcttgccagtctgcagtggtgatgacacttctgaaggaatgggataatttcatctaacttggtgttcagtgttgtctgttcagctaaaataaatgtgcccgatgaacaaagactcatggttgatgatgaggcacaaggattcagcagaagggacagccaaccctggggttactggaatgtcgggccccaatgtcactgcatagcaatgtatcccaggagtcagcggcatataggataagcacctgctattcacagtcacttgtgaacatctgcctggcttggcttcaagctttgattaggtccaggtctgctgaattttaccttctttggaccagcagcttccagagccatgtcttcatggtgaaaggcaagtccctagggatgcaagcccatctgtacccaactgaaacccatgttacccttcacctgtatcttgtttgtgggtattgcatcggccaaggcaaatcgtggggctaagcccagggtcaagtgtggggacgtgcactctgcagaagtggagggtggggatgagtgtttgctgggcagtagtacacccgaggctccgtgagaatgtctactttgagcagtcaagagaagacacagattttagacttgtaggtttcctcattccaaagttggtgtgcttgtacttgattttgaagttatctttcttccagggtgatgggggagcatgaaagtaagaggatcttgggaactgctgtgcccattaattttatggcaaatccacgtatcacctggaaaaccatccatgggatattgagtagtggaccaagagctgtggtccggattccatgcatacgttttgggaagaggctgacatgaagcgtgctattagcttgtcgagagccctgctgacttctgaatgtggcttagctcctgccacgtcctttgttcttccaaggttaactgctgcaaagggattgcagtggccagtggagggctagtgaaggttcaagcacactgacaattaggctaaatcggcagtggcaggttcttgcatggaagttgcatcacctgctggagtgactgtcccttgacctcctcctgtctactgggtcttcctccacctcactttaatgctgctatgctgctaatgtgaactctgaggctttaactggggaagtcgccaccgccccctccatcacccttgtcctacaggtcagggctggaatgaggagcacttgcagttgcctagtgggtgggatttcaaggaaacgggatacctttcttccccaccccttcaccttttcccagaaatggtctcatcactgtttccttttggaattctgtcattggaatttcctgcttttgcagctcttgccagcttgcgtttcttttgaaattcagtacgcttgggagcagtgacgcgaaacttcgcagacgctgacctcgctgacagagccaggccgggcaagaagaggtccgggaggatctatcaggagtgtgggggctggtggggcctgccctgtagcgaggcttagggtatgggcccctggggggtgagagaggacaagggatgagagttgggaggtaattggggggcggtaagaggtggagggtgaggggtgagagggccccaaaaacacaccccctgggccacggtttctcttaggctgtgctgccccagggtgggagtagaggagattctggacttcagaatgccagccaggctcccctcctatttttttcgatcccagagacaacagagttctttttttctgcatgttttttgggggctcctcttttcttgctgcaatgctgtcagaatcataaagagctgacatctataattaatgtcagtggcctgcactagtgaatgcccgtggcacacagaacacctggctgtggagaagcagcagcaggacctagcgtgttggcactggaaggaaacgcagaggcctttcccctcattttacatgcaaggaaactgaggcccagagagggggccccacagccagccagtggcagtgggctctgaggggctctggacagcagcatcccacctgagtgcgctcttggctaggcagggtgatggggccccagtctggtggacgctcagcaataggaaggggagcggtggggaatcccttctcgttcccgggtgctggtctaccagactggggctccactggggccatggtccaataccagtcctagcagtcattgaaatatggggtttcaggctcctgatccttaaaaaccctgtgtaagtagtctccaagctaaaaacaatctacactaatagatctgctcatcaaaagattattttgagagcattcgggtaatgtaaacaacctttctgctttgtagcacccagcagtgagtatctggagacgttggaaatggggctcacccgatgagggctgtgagcatgagcctcgagggcgctgcagggttcatctcatttctctcttcatttattgagcacctgctggataacagtggtcggctgttttatgtccgttgcacattattgcataccgtgtctaataagcctgcagaagtgggtgcattatcctcactgcaaatgtggaaactaaagcttggtactaggaacttgcatcaggttccctaggtggcagtggtgatgcagaacacacacagatctgcagaccttaaagcctcacgctcctgacaactgagccatgctgtccccagagccgaccttgtatgccatgacagggccagagagagaggactggttacttactgcacaccctgagagacaggaatgggcacagttgtcacctatgccataggaaatggagtgccacctgcacaatgcagtgagtcacggttctccctgtccctcctgcgaccccagcttctgccctgggctgctggagggcacacttaggggcacaaacacacctgacaacaggttgtgggttttgttggggtggagcaccctcagacccctcttgcctcttccttccccgggccccctccgttatccatcaggaattctactcttgggacttggaaagtgaggagagggaaggactagctctgccgatgtgacagtctcagagcaggatgtccctctagtgtcctgcatccagcacacgcacagcacgtgtactggaggcagctcttctggttctgactctgtgggtgcctttcacctgctggtcctcagcagagcatgcaaagggatgagggagggtgattcactgtgggagagttaaggatgggagcctctgggatcgagctccaggtctgctgtttggtaaagtgctttacttaatttgagtataagtgtttagagtgagcagctgctgaattccccacagttcttagattcagggtagaggaaatcagaagagtccgtatctgatttccatgatggtggagtgggtgcaggcccagagagcaagagcaagcctgcacagaggttctgtgccaatggacacactgactgtcgggggcacgctgaccatgggagggtgttggggagcacacagacccccagcgggctagagctgacggttcccactgagagggaggcagaatgtagagatggccatgtggcaggagctgaaaggcctgcctggctctgtggtttgtagagcagaagcccaatggccgagcgctgggccaggctttcgggatgctccagggctcaggttcaagatgctacatctctgcttggtgtcagaggggatgctggtgggatatgagtgggggctgcatggcgaagcctgtctctagttgcattctggctcagggaaggtgggcttgcttcctccctaaggagcagtttctgattgatgatggatagcagctatttttctttttatcttgttgccatgagtgtttattggggttaaacctgcatctttcctttacacattaatgtagggagatattggctttgagaaatgagtgtagatcagattgactgtttagtctaacgtgttcataattggtgcaagttgtctgcattttcttaaccaaaaaaatctaccccaggggaaaagtggactctggttttgctgagataccaaaacatgggtgtgaagtaactgggagaagctctaggaatcttctggtcctgctccaccactgccaggtcatgagcactgcaggaaggcccgagggtcaccaagacgccggcctgccctgcggtgggaggacaggggaggggtggtactgccctgtgcctcagctgactgcagggcctgggaacactggccaggagaacggcgcacagagccaatgcacgcactccacctctcgcctccgtggtgggagacgtccgggcacccttgtttgcttggagcacttcacttaaagtgggtctggctggtcattttcttgcacttaccagctttatggctttgtttcatagtttagtcctcagaacggccaaaggagaaagctgcagaagagctcaccaggaggtagaccatgtctgtgtcctccagggctggcaggcaggaggaggtggaggggtaatggtcctcctgtgaggagaggagctatggatggggagtctgatggcccctgtagactcaggtgacagtgagaaggagaaactcagtgtaccaatggtggcattggggctggcttgttactctccctgggtcctactccctcacgtggaggaaggggtgactgcttggcatgggttggcaaggactgtgtgaactgtgtatgcagacagaaggtaagtccaggcttggccagggccagagtcatgggcagcagcggtgatgatggcagatgatcaatcctgaaaggtaataaaaatgcccagggtacagcccagaaatgcctgtgatagtcccagaggtgcctggagcatgcctctgttcgctccctccaggccccagcctggcagtctcccgctctgggtgcttgggccatggccacagccttccccctacttaaggcctctgttcccactccccacttgtgggcctgctggacacctgctcccctgctccttccttgccaccccattgccagcctctgccaggcctcacctcactgcgttgaaattgagtgttttggtggccagtattgagctcacagagggagtggagctttgctcccctgtggaggagcactcagaaatgctggtgaccacagagacccctggtgttgtccacaaaggtctccagaagagagtaggggagggatgggccacccagggccgaggtaagatcctggtgagcaggatgggggcacacttcagccccttcctaaaagctggggctgagggagagcgctgcagggagctgtactgtactgtgattcagtgcacatggggacctggaagcaggggacagtagcccccttttgtggtcagaaaatttgagaattggggatgctaaatcgctggcctgagccacagaggtgctacgtgctggatttgggatttgaacttggctctctgcctggctccttgtgtttgttctctctgctccctgggaggatttgccagtcttgctgctgagccactggggatgctggggagtgagtattctatatgcatcagctggtgaagcgcttatcaaatgacccccagattccatctcacttggggaggccgtgtttccgcctccctcctgtccccacacctctgcccgtgggtgtttttccaggagagcttgccctgggtaggaaagccgaggggagggtggcattgggctgccttctcacttgctgtcacctcccttgtcctgccccctggccttcccagatccaccgtaatgaaagaccttgaacgaacacatccctcaggtactcagcccagggtcttacagaggggcggtcccaggggaagggggttggggcctgcagttttctcaagtgtggtgtgaccctcaggaatttctttttggtgatcttgtcattttggtgggtgttcatttccttgagcatcttcactgtattagtagccatgagtattactgaaaggcatttttattcttaaagcattcagggactgatagcaaccaaaattatcagacaagctgcaggagatgaaatcaatggaatttggcaattgtggggcaggaccttattcccaaaggtggctggtctagggcgtgtggactgggaggcaggcatgcagaaggggacacacccctcccatcactctcctctcgtccagccttggaagccactggagtcacatctgctgcaggaaaccctgtgtttgaattatgtgtggagcagtcacagggtggttttggctggatgaagggcatagagtggcatctagaagtgcatgggagaccattgccaatgtcatgggttagaccatgtttttgaggctttagtgatttttttgagacccttcccagtctaggccaggcagatcatcttctgtgcacacctctgcaggtgaagtccccgcatggctaagcacatgtgtgtggagtgtgtgtgcttaaggatgtgtggcctcgtgtcagatgacatgtgtgtggggtgtgtgtgtttaaggatgtgtggcttcatgtaggttgatgctcttgaacgtgctgactttaaaaaatccacactgggctcgtctgcttccctgatgacagagtttgggaaactaatgaaagacattctggccttgtgccatcagaagtgaagtcaatgtggggaacagctgcctctgggaggacgttgtctgtgcgctgtgccgcggggcctctgctccatggccggccacacagccctgtcctggaagaggcccaggcagctgtcaccccttagcccagtctggaaagagcccagggtctggagtaggggtgacagtgaggctttctatggaagctgctttaaagaaggaacaaattgagcctggcactggccttctggttttggagactgagttgccctgccctgtgcttgcagatccactcagtgtgaagggcaggacagcttcccctttccacacctcctcataacctcctgggaagctgctgaaatacaggtgttcatggtggggttaagccagcttgtgagtcattagcatgcctttccacggccaacgcacaaaacttttgtcttaattagacttgaggcacaaaccgctgattctccagtgcagtgtgcctgctgtgccgtgcgtttttgttagtgtgtctggacgtggtattcatatattaacagtgcatgctggggcacttggactgcagggcaatcgcttgcctggcggtgggagcccagaggctgaggtggtgcgtcatgttctggccacggtcaagccccggagtgtgtctgtgctctgtggggagcctaacctgtcatctgtgtcagtcctctctgagtgtcctatggggaaaagttcacttggggctcatgaaagcttgcttttgcatctgtccctgagcctggtccagtgtgagcaagctgatgccttgtggaacctggatccagacctggcagggtgtgagtctgtgtgttagagagcatcctccttccagtcctggccttgttggcttcactgcctctgcgtggctccaagcctgaccactcccttcctcccatgcccccagcgtgcctccttctactgcattcagatttttgtccactcacccggttttcctcttttctgccctgggttctgagggtccatggcctgcaggacagtttgcctaggataagccaggacacatcagaggctggtggaagcctgatctgctgcttagaatcaatggtgtttctgacatggagaggtggacattcaggtgcctatcattacatggcagtaggaaggtgcttggaccctgcaggcctggtgctttgtacctgtggattttccaagtcactttattcaaggatttcatttcactttcagttcttaaagtaagggcctggcaaagggataggcagcattctgtttctctgagggaggtaatgctctgccatcagcagatttccttatgatgatggaaaagtgtggtcaagggatgtgtttgaccctcctgtaagaagaatgaaggtgtgctgcccacgcagtggtcactccagggggcccttggttgcaattcaaaggcaagcaggaacctggaggcccagaggggcaaagggcatggggctcaggtcctgtggtcactcagcacatgctctctcagctgcaccacagtcccgcacaaggccatctatgcttatcacctgggtgcagaagaccaagtcactaaaaccccagagccaggggtttgctccaggtgggcctggactttcagctaaggccccttctggattggcacatggtgaggggagcttccacacccatgattctaaatcccaggagctctgaagcaggaatcttttccccctgtttggcatagctcatctgctagcaaaacctgctttgagctaccaggattcccagtacctttgggagtgttgggtttccctacagagatgtggtgcagagtggacgctgccccatacctcccgggaggagtgacatctcacagggccagtagccattctacctttcccagatccaaacttctccaactctaaattcgttgaccggtctgtccccagagaaagcagtcaatgctgtgagtctgcatctgaaaagacagtgagcatttgtggaccctgcccaggtggttccgccatcctccacagactggcagcactgaaatgggacgtgcaactgtccctgtgctcagctctgcactgctcttccctctcagcaactttctgatttgcatccatgcttgctctccatgtttctgtgatctcatctgtgacatacagatgacagccatggtattggcctcatggggggttgtccagagataaaaaagacccagtgattatatgccacagaattttgcatccaaaatttgcattttaaatttttccaagggacttttttctgctcgggtctagcgaatggccccttggtctctcctgtgtagtgttttgtggtcacaataaccctggattcctgatgccctggtggagaggcgataccagtgtctgcagaccataagaaagtacatcttgactctgaaccacagctataaataaattgacatgtttatctgtgggcttacagtgacatataaaatcttttcttgaggtgcttaggtatctctaggctacctgagatacctaagagagatacctcccttctgagagcaccaggttgggacactacgctcaggtgacttccatgcaccctgcagagccaccctcccccttgaccctgttggtgctggagactgcatcatctgcactatatacccaggcgcaggtggttggatttgtccaatgggaggcgggaggggaactgtgagatcagggtgttccccttctgggccctccctcggatcctatcagaggcctcagatctcatcagaggccctctgcacagagctcttctctgtggcctctgcagagctttttggcccttccctttcaggcctcagatattaaagcttcgcactgttgccagttttagggcgctgcactctcctgtgtgcagtttcctaaaccccactcatagtcctatagtttttcttttgctaactccccttagtgacccaattaagtgtgccacctctctacatccaggacctgcctgttcaaataagcaagccagagaaaggttcaagttcttatttgaaaggcgaagtgagccctggcatgggccatcccatggccttttggctgactgccaccagcaggttgagctgtcccattgtcacatcactagccttaatatagtctcatgccctgaagttgtcttgtttgcccacaagacaaggctatcaggaaaatgctgtgaaccttggtttccaagaagaactcaaacttagatgcgatgtgtttgcagccattcagaataggtgcaaggatccaaatccctgggcctcaagaacaaagaaagttaaaaaccgagaagactgtcattaactgtaattgcttttgcataactcctttcagagttattgcaggcatggagtccggggagttgcccatagttcttaatgtattagggaacaggaacactcagaggtattctcatctaaagaccagttcacaaaggaggcatttgaatgtggatatgccagctttaaaacccgataaagccagaaagtatgagagcccacagagatgtcattaaggaaattatttcctcccaaaatagaggcaccccaggtgacctctcaaaacagaatttttgtcatgttggtctggagtcacctccatttcctttctgttgagaattgttctgtttcctgacagcacactgggatttttgcaaggcaagtcattgtcacccaaggagactgacttcttttcactcaattacgtttttttctctttgccgggagcctgggagattgctggacctgacccctgtcttaggaacatgggtaaaagttgtcatgatggaagacacatggctgggacagcagatggctagaaagctactacaggaggactcaaatcactttcttatttagtagcttctggaaatctttatgcccatgtggtagaaaaacagatgggtgttccgtaaagaaagcggcaccagtgtctgcagagcataagagattgcatcttgactccaacccatagctatgaataaattgacaaatttatttgtgggcttatcaaggacataaaaaatcattctggctggcaaatgaaaatggcattgtgttgctcactaacattcgtttgtcaactgttcctggaataggtgctaaattataactgaggagctggcgttataaagctgaactggattttccaagctgtcatatgaaaagaaaattattaactatctcctcctccatcccctgtctctctctctctgcagaaaaagcccctttctctgctgtcatatgacttggactgcacgctctatgtgcacacggtgtaatgaatgccacattatcacccactggctggggtgagccttcttgttatttatttccaactggaacaggatttcacatcccatgctcccacacaaaggtcttagaaacaaccatttcagacagttccttgcatcagagttttagggtactcttctgcacacaaactgttgttggaacatgagcttggatttcttgatgctacatgtcacggattggcaggaaatggtctgggtggtgctgctcttatacgcactcttggtcagacattgtgtgtggtggaaatctgtgtaaggatcttagcaattatggggaccatggtgtagcactgggatatcttacttttcacttagatgtctctgcttttggttttgagacatcacgtggaaagctatgttggttttcatcctattccatggctctctggtgttggcaggctgcacttcatagcatagaagatgaaacatgatatgacttcaggaacgcatgctgagggaagatgtgttgtcatgaaaatacacttttttttttaagctggaaactgggtgacagtgaaatcttaaaaactggggaaatcgggaaatcaactaactttctcagatcttggtttcctcatattgtgtatcgcattgcgggtttgaaccagaggattgctgaggttccttccagctctgcttctagttcttaaatccaaagcctatggggctcttggagtagctcaaggcttctgatctttaagttgcaaacagaccactggggggaccttgttaaaatgcagattccgattctataggtacagggggatgcctggaattcaggattaaccaaggaatctctcttgtgatgccaatgctgctggtccgtggaccacactttgattaccacagatatagatgaccaaagttgcatggtcctggatgagccagatcccttctttgtccgggtggcttaggtctgggtggctctttcatatcttcagacacatcacatcattccttctctttgtcagtaaagacagacaaggaaaatgaagtgagaacttctctttctagtaatataacacattgcccccaggcacgtaatacatacttattagagtaaatgagtgataagagaaattagtgtgatcagggatgaatgtaccataaatactcaaagtcccttcaacctgccacacacgaacacacacatatatgcatgcaccagatttcattacccggaatcctcatgttcgtattctatagcgcccaacttctattttcctcactgtctcctacacatattatgcctagctaggctatgtcctctgactatcctttggcccgcccaatgcctatcattttctagatcaatgcaagtcctaagtcttcttgaagcctctggattcctccaactcagacgccctccctccctgttgtatccatggtctttgggagcaaggatgcagacccagacctgactgctgcacctgcccagctgcactcaagggaggtgctgctgttacacccatacctttcctgggctcaggactgggcttcagagcctttacaacacagcactcttgatggcttctaacaactgcctgaaacatcttttccatccctgatttaaggcttaaatattatttttattcttcatgtatatattctcttcctgttttgccagatggtaaattcgttgagaatagctgctttttactgttttcctggggtgcccggcaatatgccgggtacatagtaggtgcacattaaatgatgagctgactgcctggagcagcactgagtcatacattctcatgtgctggggtaatgcttaacacaacaaataatcccatagcttccttgaccccaaaggtgtccagaaccagtcacttaacagctgaaatggaccctgatttggggcacttgtctcatgaacgtggggagagtgagagggcaccatctcacatgattcctttgaaaatgctgtcaggatattatggagaaatgccagaaagcaacaacagaaggctgttgggagaaaaagaaacagagtaatctctttttttttttttttttgcattatgcttgaaggaggttgtttgctcttcagtgttctacatgcagctgcctctattgcttttggttggaccaggcccatctgcccaaacagtgagtggggattatgcatctcagttcctgcaatctcgcctggctgccgtgcaggagtcagatggtagggccaggaggaccgggctcagggccaggggccttcgggcacgtgctgcggaggagcgcttgtgagatgcacatgccatgtctgcagccggcgatgcccttggaagaagctcctgccactgtccctgtgatctgctgagcccaggcagctcctcgtggtggggaaatgtgtggaggaattttggaagactggatattgttccagtggggtgtgagatcctctggccttaagtcgctcctctttgctcctctttgtctcccaagccaggcttatccgcaggtttcaaagtggggaacctgaacttggtaaggtctccagtttcaggtgactgttgtgtctcagctctgtcaaggagcagctccaaactgagccatatttcatgccttctcagtctaaagataatatacttttttgtttgtttgtttgagatggagtctcgctctgttgccaggctggagtgcagtggcacaatctcggctcaccacaagccctgcctctcaagttcacgccattcttatgcctcagcctctcgagtagctgggactacaggcgcacgccaccacgcccagctaattttttgtatttttagtagagatgaggtttcaccgtgttagccaggatggtctcgatctcctgacctcgtgatctgcccgcctcagcctcccaaagtgctgggattacaggcgtgagctaccgtgcctggccccaatatgtatttttaaatgtttctttctaattaaaagcatcatttatgttctctacagaaaatttgtaatgtataaatgtataaacataatatttttaaataggaaataaaagttgcccttttcagaatccagagagtccccttgttagtgtattggggttccacatatgtgtttgtttttcaaacatggctgggatcatataaacatgaagttttgtatcctggtcttttcacttaatgctatgtttaattggaatattttcactacactaaaatgttctcaaaataggatatttcatagctgtggaagaaatcattgcgcatatttcccatgatttctgtaactgttcacctatccgacgtttagcttgttccagtttttctctactttaaatgacatcatcccctagtttcacattgcattccctgatttctattttgggcatttttctttcctcttgccaattttctatctatagactctgcctagaaaagcgtctttttgggatggtgctgagaggagcacaaaccggcctggtccatgtaacagcaatttgacatgtatttattcattttttatttttttgagatggagtttcactcttgttgcccaggctggagtgcagtggcatgatcttggctcactgcaacctctgcctcccaggttaaagcgattctcttgcctcagcctccccagtagttgggattacaggtgtgcaccagcatgcctggctaattttgtatttttagtagagacagggtttcaccatgttggtcaggctggtctcgaactcctgacttcaggtgatccacccatctcagcctcccaaagttctgggattacaggcgtgaggcaccgcaccccaatttgacatttaaatggcatctgtcagctgcagttcagggagggtccctgcacaagcaggaaggactgtctcgccatgacactgcaggggacacactagaaggaatgggacacagggacagagctccgcaggcagtgccctgggcctccgatggtgctgtgtggggccctgcagacagactcaactgccttagggcacccgtaggagggaggacagagggatggtggagggaaagccttctgctaaaaatacccagcactgcactgcgaaggagtttggatgacaacttgtaggacacagaagtgtccatttgtgtgtcatcaggggccagaaaaatctgggaaaggggctgcagccctgttctcttgtctggactgatctggacattgagtccctgatgtcccaggctaccccagtggtgaccgggctgcctgccctaccctgcccccttctctctccactgccagtggtgggtcagcccccatgtcaggcagtcatcctctgtcccctgcatgcactgaccactagaaaacaaagggtgtgaagcccatgccaacctgggaagcctcttcctgaaagtaagtcaagtttccaagactccttcatttgtctttgggcagggccctctcaaagtggggatgagttacatcggaaagtgagtgtcctgtcctagcaatgttcatgttggctgtcagccttccctgaatcacctgctcaaagccatgtgaacagggtgcaccctctcccagctgtaggtgaacgctggggttttgttacagatcaggagtcgggaatgctgggagccgcagcccaggtgtcttgctcctctacctcacatttccctcctgtgaaacagcctgaggcttgttgccgagtagccctgactctttaccaatggccggcgccctcctctatgttctccaagagcttccctgggtgggggtctagcatccagggggcagtgcttggccgagcagctggttgtgtcacatcccttcttggaatggtcttttctctgcctggaaagtgacctggattcttccttctgacatgtaagatggagctctgttgtggtttatgattgctccttgggcccctccatgtaatcagtttactctgcccgaaagtctttcttccactgtttcaaaggaggaatttgtatgtcacatacagctccttggtgggggattttgctggagacatggggagctgctctgaagacagtgtcctgcctgtataaagaattgctgtgccgtgtgcggtggtcatgcctgtaatcccagcactttgtgcagccaaggctggtggatcgcttgagtccaggagctcgagaccagcttggtcaacatggtgaaacctcatctctactaaaaatacaaaaattagccgggcatggtggtgggtgcctatagtcccagctactcaggaggctgaggcacaagaatcacctgaacccaggaggtggaggttgcagtgagccaagatcacaccactacactccagcttgtgtgatagagggagactcagtctcaaaaaaaaaaaattaattaaaaaaaaggtaaaaaaaaaaaaaagaattgctgtgagagccatccttgcattcttccatctgatcatcataggcttgagcaccctgctgggtgatgtggtgacggggctgggctcagctgggaggaagacagacacagccctacaggggaagctagggccacacccaagaaaggggcagtcacgacccgagtgggaggatggctccaagtgaggaggtaccgactcagcccaggcttagccaagcctctgccccagagctgggcatcttggggtgcacagaggaggtgctgcatgagtgagaaagacttagtgaggagagaagcagggagggaaggaagtgggtggcagtggaaacagcactttcccagttgttctttcagccgatgttcattcagggctcatggtagccaggccttttccaagctattccatggattagccatcgctatgaattctcaggatccctgcaggaaatgccactgttgtccatgtcacagatgagaaaattgagatgcagacttagagtatctcatccagtggcatgcaagtggtgtggtacggagcacccacgcctggcctgcaggtgcctgcccctctccacccctgtccagtgatgagcgagctcatggcaggcatgcaggcaccctgggctcctttgcacacactccctcgcttgggcctgcggtggctccaggaagcaggtgctcttgtcatccccaatttgtagatgaggaaaccacaggtcagagaggttaaacaattgctcaagtcacacagctggtgagcaccagccaggctgtaacccaggccgcctggctctgaagtcttcagtgtctaaagaactcagggcgggagccgaggggcacgcagggcagggagaggaccctgggaggtgaggctgggaaaggaagcagggctggaccctaacagctttgtccttcttgtgaagaagggggcttcatgttgagagaaggaggtctcactgtggagggccaggtggtgatcccagccacatgcttgtagccacctgcaagtgcccaggcatgctgcagactcactgcagccccacaggacaggggcctgctgcctggttggtgtcaggaggccggcatttggggacatgaagatcagggagggggaggtttacctggggaggttcacctgaatctcccatggttgtgagatcttgtgggcacgtctgtggtggactctggccggctttacggatggctgcaattggcactccctgcacgggcatctctgtgtagcttgaagctggactctctctcaggtgtaagtgggagctccttagaggtggggcttgaggacagaacccagcctcctgcctgtgccgacactgctccctctgtgactgtgagagacattgcagcccttcactatagcttggttggagactgacatctgtgaaggattgatgggaggctctgaaggtgctgtaatgaagtttcctccccaggatcccttccctgccccagccaggttggccccccagaaggctgctgggtccattcactgttctctacgtctgtgcgcagcccccaaccccgcccatgtcagcattatcccctaggacccagagcctcctcccatctcctggcttccactctaaacagaatgacctagtattattattattattattcgagatggagtttcactcttattgcccaggctggagtgcaatggtgctatctcggctcactgcaacccctgcctcccaggttcaagtgattctcctgcctcagcctcccgagtagctgggattacaggtgtgcaccaccacacccagttttttttttgtgtgtgtgttttttattgttagtagggatggggttttaccatgttgttcaagctggtctcaaactcctgatctcaagtgatccacccgcttcagcctcccaaaatgctgagattacaggtgtgagcctctgtgcccagccttcagaatgaccttttaaaggtcatcagggcatgattcctgcccctccttaacatccacctgtggcttctcagggactcagggtaaatgagctgggccctgcaccatctgttcttgctccctttgctcctgtgggtggaggcaggtgtcatgggcagcagagattctgcagagtcccctgtgaggtgaggggagtgcagaggattcgcgtggcctgggacttgccatggcgtgtgggaataggcagtggtcagctggggacactgaccacactagcagagctgctgccagtggcccccaaggcgtctcacctcctgacagcactgctatagcattgccagatgttattttgagttttaaacacaggagtgtggattgggctgcagtgtggattaactaggcctggggacctaccctgaggagctagtgatttacctatttcctcctccattcctgtagcattctcttactgagcacctgctgtatgcctggccctgggtatttggtggggccaactagactgcagctgttggtccaggtggggggtgaccgggatgggaagcccaatacggctccacagagagtaagaaagctgtgggggcagtgagctagggaggacagcagagagagcagggcctctgcaggggggtgagttccccaagaagaccctgcgattcattcagctgtttttcattgacaccatcatcatcatcgtcatcactgttaatacaaatgctgtacgtaacagagaagactgacttctgcttccatcttcgatgagaccctttgctcagttgagagaaaacccaccaaagaggggaagggaaggaggagagattctgccccccaggggagcagcccacatagccgcctgcaagaggcctgtgtacccaccctgggcatacctcctccagagccagaggggtgcctggtgtgggtcagtgctccccaccagaccagtgcctccgacccaagtcagtgcctcccacccaggccagtgccccccacccaagtcaatgcctcccacctaggccagtgtccccaacccagtcagtgcccccaacctgggtcagtaccctctacccaggccagccccatcccaccaggccagtgtcccccaccctggtcagtgccttccactgggccaatgccccccattctgcccatgccccccaactgggtccgtgcctcccaccaggacagtgtcccttatccagtcagtgcctcccactcagtcattgcccccaactaggtcagctctccccactaggtcagtgctcctcaccaggacagtgcccccgacctgggccagttcgccccacccaggccaataccctccacatgggtcagtgcccacaaccatgtcaatgctccccacccagatgtgtgttccccccccaccaccagactagtgcccctcaaccaggccagtgccccaggcagccttgggtttgcgcctcagctggtgacagctgaggctggtgtgtggtgcagtgtgggaacgtaccctgtgggatgttctgcactggaggtggggatctgtcccactcaaacctgcttctcagggggatgcagaggtgaatagggcattgtggcagtagccaagggcgggtggatggcccagctggtagaagtagctggggatagagaagtcaccaaatagatgcagagaagggaaggagaggcatggagagcaggcaggagcatgatctcagctatgtccccgaggagcagagagaactccgtggctggctagacaggcgggaagggaagcgcatctatgtctgtcatccttgtccctgcagttctggagcctggttcagtttctgctggggtagaagcacctcagagcagagtgatggctgccctagttcccatggtctgtgggtcattgaaggagggtccctcacggctcagggaaaaaccatttctgagcccaggctgggtgggggatgatttaggtcactttgctccaggtggtgagccccaccctgaccttgactttggccaactgttgtctgccagccctgcaggaggatgagccccggggtcctcagggagtgccagctgaaaggggtgtcagtcaaatgctcctcggagcacacccgttccgtgctccctctggccaggccttccctggctcctgtgggtccaggtccgtttccccacactgacataccccatcagctcaccctgtgaaatatccctgatctaaccttcttccacccctggtctggtccctctgtgtctctccccaggatgacagagctgccaccagagggtcctgtttctgcccttgccctagcatctattctcaaacagtgaccagagtgatcctgttgaaagggaaggcagatcatgccagtcctcaactcagaattccccagtgcctcccatcactgtcagagaaaaagccaggccgtatgacacggcccacgccggcctgcaccaacccccacccactgcctccctggtgatgtctccccccagtgccctctgggtcacctgcttcagccacaccagccctgtcttccccacaagccactgggcaggctcccccagggcatttgcagatgaggccccctcagctcctctccccatgggtgttgcctccatgccacctgctcacggggcctcctctgaccactccagttaaaactgcgaccctgcctccccaaggactgcctgctgctttctccaaaggacctctcactctttagctttcttgggattttatttatagattttattttgttatttcagatgaaaatttgaagcttgcaggggcagggatattttcccatttgggttactgctgtgaccacatattccagaaagtgtttggcacatcagggtccttgacacatccttgagtggccatccttaagatcaccctaagggtgatcttaagtctgccagccaccagggccttttgaagcagggagacctcccatgatgtacccctaggccttagccttgcaccccaggacaggaggactgcgctcccaggggagtcaccaagcatcatcatggggtgacatttccttccatttcctaaagtttccttgcatgagctcacaggaaaccttgaattgtaaggcccttcctttgccctgtacttgccgaacctaaaagccagttctgcccggaatgttctaaataatcagggggataaagaaagagaatcctcaagcaaggcttttctttcactctctgctcagttggcagcaccagatggaggatgtggccgtggtgtgggctcgtttatttattgattaaaatgcttacaaaacccagcatgtacagccaggctgaacattcaattaaaaagcccaaaatgaaaattcagaactcctgaatgacaagtaggatgtgcagagccagctcttagcaaaggaataggatgataaagctttaagcagggatttgttctatttatttatttcgctctttcttcaagaatttggaaactggaaggcactgcacagtgcccagtcactgcatgggtgagtgaatgaacaaagcttacacagtgttgggtgagcagcaaggataagagaggtggacatttgatgacagctaggtgcatgtgtccctgcacacacagggatgggaagaataatggccctgagatatgctctcgagagggcatcctgaaatttttttttcttttctttgagatagagtctcactctgtcgcccaggctggagtgcagtgaacctccacctccagggttcaagcagttctcctgtcttagcttcccgagtagctgggactatagtcgcacgccaccatgtctggctaatttttgtatttttagtagagatggggtttcaccacgttggtcaggctggtctccaactcctcacctcaagtgatccacccacctcagtgtcccaaagtgctgggattataggtgtgagccactgcgcccatccgcaccctgagtttttataccaggtaagcccttgagtgaggaaaagacatgaatccatgctccagagatgacaggcatccttttccataggggatggttaggggtatgattggcaaatatgcactgggacttcaggttcttcctggtggtaagaaaccactcgtcctccatccatcttcctcttccttctccatccaaccaccttcctcttcctccttcaccaccttccaacatcagactgagcacactcttcagagcccaccagctggagcagacttcatgtgggttgggctccacctcctttctcagaagtgagtgtcatcacctagagtgtcattaccacagtctttgccttccaaggctcctactaaatcagaacgacttaaaaagcaagcagagtgccctctctgctgctttggaggcagctgggccatggttagaaggtgagggccacagcatggctgctggctaccagctgcagatgctggtgccgactagccttgcctgagtctggcttcctcatctgcagaggggcagggtgtctcacttgaaagttgggagacttcaatacagttgtgtatgaagtgcccagtacagtaaattctcaataaataatcattgctattttaatactgtgggaatagaaggccagctcactagctgcaagccttagattagtccaaagacagcagagtcaagagggggattgccctggttcctctgcgcaggctgatgtcaggggtttgctgatctctgtgcaccgggactcagactttctcccgtgtggccacacttgctgtgtgtggtgtgtgtctgtgtgtgtatgtggtggggggcgggctgtgtatctgtgtgacgtgtgtgtgtgtgtgtgtttgtgtatgttttgtgtgtggtggggggaccttgggtctctgtctgtgtatgaactcatgtagtctcccctgcattcctctcctccggggattgctggccccttcgctgtttgatggcaggtgtctgaggatggagagggcagtgccgcagagtgacagcacagggcatgccaggacaccagggtgcccagagcccataaaccacagcctctgacagcctagtgtctacgctaccaccgtccccagggcctctgtgggctcagagcattctccccacctcaggccatgccgagaccactaggctcctttgcatagaaatttgagctgtattttgttgttttgaggagaaaagtggtttctcaaaggcctttgattcccatgtatttgctaagctggccttgcactttcctacccatcctttttgggtgggttgcccacaggtaccatccttcttgtcttcattctggccctgtcttgcctctttagcatgtttgagaattttggacaaatggagagaagtctgttctcaagggtgttggcctaagtagcttccccggtgcgggaccggggtccattttctgccctccttcccgcagcctctcctgcatgtcttcctggacctgtgctgatttcagcatcttcgttgtgtgactcagttcttctcaggaagccatagaggtttttctttctagagctttgagcatttgaagaattctgcccactgtgtcttctctcctcccactgcaatcgatagcagagaatggagaggctggtcattttttcagactgctctgttgaacacggatctgcaaagctggcgttggtactcctacagccagtgctgggacacatgcaatttgtggtgtgtgatgctttcaggttgctctaagtgtcagtttgacatacctgaatcctggggcatttttttgtgactgtaatcatccataacagcatatctgtgatggatcagtcaggatgggaaagttaggctgcaggaacagcaaggtgaaatgcttgctgcttctgttcatgctgaccatacccaaacacagaactggtgcaatcctgccatgccatggaggcagagagccaggaataaccaggcacaacatgtgcctcctcttagggcccccataggggagggctctgcctgcaccgaagatgctccacagccctctaggagcttggggaccaggccagagaccctgtgctgtgctgctgacagtgctaaattttgacagtgctaaatttcactgctgcgtaggggattagccagcccaggccgccaggtctggctcgggatggcgtgacctctggagttttccacagtcctgccattggaagtgatcccgggagacaaggcatcatggtgctcctatgttcttcctgttttcagacacgacatttcacctgcctctcggaggctgaaataagttaaataaggttatgctggagaaaagtggacattctagtgatctctacatctgaacatgagatcagattatctgatctccttagctttttttgtttgtttgttttttgaggcagagtcttgctctgtcctccaggctggagtgcagtggcatgatcttagctcactgcaacctctgcctcccaggttcaagcgattctcctgcctcagcctccctagtagctgggattacaggcatgcaccaccatgccctactaattttgtatttttggtagaggcggggtttcatcatgctggccaggctggtctccaactcctgacctcaggtgatccgtccgcctcagcctcacaaggtgctaggactgcaggcgtgagccaccgcgcccggccgatctccttagtttttaaactccactgtagccaaagaactttgggagagattcacttggccccaacaggatctgaggaccacctccctcacatatgcttcccagtgaatttggaacgtccatccatgtgaggaaagagcttgcctctggcagggttaagacaaggtgtgcgttcagttgaatgaaggtgggcactccccactttgggggccagacttttctccttcgctcacactatatttttaatgtaggatgatctttgtgtagactggtacatggcagaacactaagaagatgaaactttttaagtgaaaatattttcaggcctaggtagccagtaaggtgaccctgcaatggtctgtttccttctgagcctccaggaaggaaacccacccgatgatgcccaagggacgggagagggccgccacacgggctggcgagacaaagtcagggaggcaacagagccagctggcaagtgcaggagactgcccacattcgggttttgttttgcttggtattttagttttttaaaaaccactttgttgaggcctggttggcatataaaaagctgggcatattttacatacttaatttctacatctcgatgagtctgggggtgagtctgtgaagccatcaccaccatcaagaccgtgaacaagttcatcacctctcagagttgtgcatcgcctcctgcctcctttgttattaacattgttattatttttggtaagaatccttactataagatataaccccgtctctactgaaaatacaaaattagccaggcatggtggcacttgcctataatctcagctacttcagaggctgaggcaggagaattgcttgaacctggaaagcagaggttgcagtgagctgagatcgcgccattgcactccagcctgggcaacaggagcaaaactccatctcaaaaaaaaaaaagaaagatctactctgctagcagttttaagtagacagtacagtattgttagctggagtcacactgctgtacagtagatctccagaacttactcatcttgcagaactaaactatagtcttggaccaacacctccccattccaaccccagcccctggtaaccaccattctactccctgcttctaggagattgactttttagctccaacatataagtgagatcatgtggtatttgttttcctgtgactggcttatttcgtttaacataatgtcctccaagttcatccatgttgtcacaaatgacaagacttccttcttttttaaggctgagttgccccacgttgtctgctaggggttccttgttccctgtctctggacctgcttcctgagtctcctctctccaaccccagggtgtcagtgatgttggctctgactgggtaagagtggttaactccgctgcacccgtcggcactgccctcaccctctatctttaagttcagactatttagagctatttgagtttgtatttaaatgaattaaaattagataaaattaaacatttgatttctccgtctcactagccactattcagtgcttggtgctagtgaccacagcatataggagctaatctagggagaggtgcagcctgtggaggaaaggagcagggacccggctcagccctgcccgggacagctgtgaattgctagattagacctcgtgagagccacttcagggggaaatgggagctcagagagccaccttagaagacatggggtgacgctgctgaggtcaagtgccagagtgaaaactgctcggttgggtttctgtcctgtctgtaaaatcagcgtcaacttatgagtaggaatgtttaatgtgtgttgagtgcctcatttgtctggatatctggtttcactggtacttccccagcctgggtttgttgcggttccccgtctgaatgttatttgggtccatgctgtaagactgccttctaagagacttctgattattctgataatattaatctcttagaaaggggtccacagtgggggttatgttgatcttctgggttagttgccagggttgtgatgttctaatatatctctttctcagctggttttaacctgctgacggtttccccctgggaagttcagtgattcattccagactggaggcgttttgactgaggcctgtcatgaagttccctgagaggatgaagcgcctcttctgtggttacctttaatggcaggtatggccatggaggcccatacaggtgtctcggggcaatcaaaggccccttcttaggggaacatcgtgcttcctatttccctgtctccagcccagttctggcccctggaggctcaaggagcacctgctagtttccttctggtctctccaccttacttcccactctgggcgcagaagtgctgtgtggaaattatgcaccaggaagctccgtacaagcagtagagagtctcagctaagctaagggagatgagaatacaaaggtctggcaggtcctcttgactgtgggcctcatgtgcactcagcattcgctcagttccactgcatgcctgtcactgtacactccttcatgtgcggtgtgtggctacaatgcgggaggacgcacattccaggcagtgttctctgcggttccctgagacagatgccacaaaacttgctggaggtggtctcagaggctggggctgctcggcatctctcactgagaaagagcaggtgacagagaagaaagcaatccacgcagagccctttcccacaccaggagttcccctgagctctgccctttgggctgctcctccagctgctcctccagctgccccttccttgctcattcagcacggtatttagtgagcacagtagatctgggcattacagagctacaggtgacttcaggagtgattcgctgccttctgctgggctcttactggcagcgacagtgggatgtgcttgggatattgcttttgtctacctcacgctaaagttgtttcattcaacatcagcaggaagcagataacattgtcaacacgtcgcttatagagaaaatccactaaaatggtcagagcagaccgtctttcagaagagatgcagtctgccagatgcagaccccaggaagtgtcagcagtggggccgggatgaggggtggatagaggggtgccacgtgtgtgtttgcattccaccctgcgatgttgttctgacccctgtgtgtccctgcctccaacccctgcgcatactccagcagcacctgcagagtgcttggagattcctcctggaggcttcccggggcttccgattccatcctgctgctgcccttgcaggcaggctgcacataccgcagaaggtatgggagcagagcaggtgccatggaggggcagggcagggcctctttgtacatctccgacctgcccttgtggatgctttttctctgaccgtacagtggctggtggtgttctccaggcaggaagctacatgccatggccgcaacccactgttatgcaagtatcggaatgatttcatgctgttagcagtcggtggaccccaaatgcccagtaacctagcatgttactgaagacaactccaacctggatggcagaatcacatttcctgttgcttggtgattccactaggggatggtgcaggaagaaactaaaaaactacagggacctttgatagactggttgattacgtatttcctaggttgctctggtcgacgtgtatgttgagtaagctgcaggagagccaaagcttggttcaacgggtgtgcggtgtacggtagggccgcggcatgcatgcccgtgtggatggctgatggtgtgctatggaggtgtttttgctcaattgcttgccgcttggcatgaacaacacaggtaacataattgagggcacacattattatggcagtgcagttttaatttataaatgtgaggcttttgtgtctttattgattctttgtgtaatcaacagacattctttatttctctcttacagtggcttgaaattaaaaaaataaaaagtacctgttgtactcttcatgagggaacattcacatttagtttccactgctgggaggtgcacatttgaaaattgaatattcataattacctttttgcacattggacttgtgtgtagccacattgatttaattcgcaaatttgcattgtaatatatgatattgaagatgttctgctaggatgctcacaggagcacttggccagaagttaggaggggaacaatttgtgggcaagcagaacgctgcatccatgctctgggcggaagcttggagcagataagatgcactttttttttttattattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgctcttgcgatagtttactgagaatgatgatttccaatttcatccatgtccctacaaaggacacgaactcatcattttttatggctgcatagtactccatggtgtatatgtgccacattttcttaatccagtctatcattgttggacatttgggttggttccaagtctttgctattgtgaataatgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaagtgttcctatttctccacatcctctccagcacctgttgtttcctgactttttaatgattgccattctaactggtgtgagatggtatctcattgtggttttgatttgcatttccctgatggccagtgatgatgagcattttttcatgtgttttttggctgcataaatgtcttcttttgagaagtgtctgttcacatcgtttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccaattttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggcccttttttggttccatgtgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaactgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaaaagagctcctgaaggaagcgctaaacatggaaaggaacaaccggtaccagctgctgcaaaatcatgccaaaatgtgaagaccattgagactagcaagaaactgcatcaactaacgagcaaaatcactagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctgaaaataaaaggatggaggaagatctaccaagcaaatggaaaacaaaaaaaggcagggagtctctgataaaacagactttaaaccaacaaagatcaaaagagacaaagaaggccattatataatggtaaagggatcaattcaacaagaagagctaactatcctaaatagatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaagaattgaactcagctctgcaccaggtggacctaatagacatctacagaactctccaccccaaatcaacagaatatacatttttttcagcaccacaccacacctattccaaaattgaccacatggttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcagtgaatccaggagctggttttttgaaaggatcaacaagattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcaacacatacactctcccaagactaaaccaggaagatgttgaatctctgaatagaccaataacaggagctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattagtcaggagaaggaaataaagggtattcaatgaggaaaagaggaagtcaaattgtccctgtttgcagacgacatgattgtatatcaagatgcacttttattctagcttcctaaaagcaatggcccttgatggcaagactgaaggactgctgagcacttgagaggagacccagtctgtggacatgcctttctgactgatgtaccctggtggtggttttgtttttccttgtctgacttcactctgaaaagggcgctaatttcaagcgatgagcaagtcatatcaaggctacccatatggcagagacagcaaactttactaaaatggtggtttgtccctttctttattgttatttttttaattaaagtttgaagttgttttctcgttttcttacatccacattttcttccatgccctgccagtggatgagatggagtcacagattttggagctgatgtcttccatgagtcgtggctgtgtggtggtgaggtcggctgctgctggtgctgtccagttttgaactgacttgagcgttgtggccggtgtagcagtcagccatagactaggggaaccttggtgtatgtgtttttatggtttcctttagcattgttagttcaaaagtatgtcacctattcagaactggttatttggttatttcagaactccaaatcttacaaagtctaatgaaaatcttacacaatcttacacagtttagtaaacaaaacacacaaggccagagggacaaatgtacctcagagctggggctctgagtcctgcccacttttcttgtgaatgagcttcccactcgaggttggcttgctcctctttctaataattctaacaagtttaacgggttttttattgtggtataatacttataacatgaaagtcattataaagtgtgccagtggaatttatgttttattatattaatgatgtttcgaccgtcagcactgtctagttccagaagtttccttttgggaagttttcatctccccaaaaggaaactctctacccatcagcagccaccccgctgggccccttcttcctggccccaggccaccacaacctgctttctttctctgtgaatttgcccactctggagatttgatataagtggaatcatccgatacatggccctttggtctagcttcttttacttcgtattttcgaagttcatccaggatcatagagtatatcagaattccattcccctctatagctgaagaatgtcccactgtatggtatttccacattttgtttatccattcatctgctgacggacattgggctgtttccaccttttggctcttgtgggtagagctgcacttaacatttgggtacaaacatttgcttgaacacctgtcttagattttgggtgtatacctaggaatggacttgctgggtcacgtggtcatcctaggtgtacgttattgaagagccgccctatgttttccacagcagcccttggatttcacttttatctacagtaatgcggaagaagggggctgatttgtgacaggtgggcaaatctgcagtgttaagaagaggcaggagacagggaacccatgcaatccacatacttcagaggcaggtggtgctcctggctcacactgtaggtaatatttgccctgtgcctgtcagcttcatctgtgtgcatgggctgagctgggaagaaccaggggacctggaaaggggttagggagcttgtctatgccagcatccttgacaccggcatgatatcaggatccctattcctcttcacaaggcccaggccttaccccaaacctgctgtacatccatcccaaggggggaggctggcatctgtgtttcttgctgcatttatttaaatgcagttcagcctaatgcacagcccgggatgagactgcaggtgaagtgtcatattttaagatgtgctcatgagaggcatggatacaaggccaggcctccctggctgacatttgggtgcttgccatgggccaggccctgccctccttgctgggtgagcgctgtaccagttggtcatcgcaatggtcttaagcatcactgaggaagacattgaggcccagatagggactgtccttggccaaggcctcctagccttgagtaggggccccggccagcagtggggctcactgcctctcaggctcaacatcccagggggatgggaagaaaacattctgggagatgagtggagagagactgattctctgtaggtgatggcatgtgccttgagctgaaaggtgcttccggtttctttgtagcgatggggtcagctgctccaggcagctgtggcagcatgagtgaaacagaggggcttattccagtgcatgtgggggagaggagggaggtgggctcagccagagcagagggatttgaagagtggcagtggaggagatatttgaaaggtgtgttgggacccgtatgcagggtgccgtgtttggactttgttttgtagggcacaagacagttgaaggctttggaactgggaggaaagtgacaagaaggagtaccaggctgtgggacactggacactgagaaaaggaagaggctatgggggaagagaggggccgtgagacccggggcaagtgtggacttgggggacacagtagcggaaagcagcaggcctgggcagtcacctaactgcaggtgccaaggtcgtggtctgtgtcccgggagaccagcgggtgggtgtccagagatgggggcaccagaaccatgtgggtcatgtatatttaatgctgcctgcttgagaaagcaggggcttggcatatgttttaggagaaagttttatttcttgaaatggttaaactgataaatcctcagttatcccaaaggctcagggttccagaaaatggctccgttgaagggtgaatcccatagatcttataagagtgattgtaaccctgccttggtatagccagggagcagagatagagggtaggaaccagattgccctggggaaagcaggtcagcctgaaacggcatgacctttgatgtcacctccgtgcaggaatgaatttctctaccatatgaatagcaccatcaactaatacatttttattattcctgccacttcataaatagtgtctccatcttaatttgcatgtgtctgtcactctccatggtctttaaaggtttgtataaacttgtaaattaatcctcctttacatgcataaggcaaaccagctccttgatgaaacctttgatgaatctttttacaagtgcataatatccaccagccaatttcttattctgtaaattattttgccattttggttttgtttaatttagggtgtgacagtactggcatcatatttctgtctagtgaataggagaatcagaccaccaaaatattagaggagaccctctgagttggtagagattgaagcagagctaagccctcgctggtgaccaaaagaaacttcgtctccccgtatgaatctcattcttggcaaagcccacagtttgagaacccccagcaggcattccagagctgcactgtcccataaggtagccaccgaccacactcagtgaacagcgaccacattgaagagcccatacacgacacgtttccatcagtgcagaaagttccactggacagcactgctccacaataatgaagaaaaaggaaacctgttttactttactgagtataattagcagaaagtcttatttgatgacttttctctgggtcccccttgtcaagtgtgagtcctctgagtggagagggctatagtctctccatagtaaggcagaaagacgtgcccactgggaaacacccagcaatttaatagggccctgggtccaacaccaacttggagttcttaactaatgccaagccaggtaaagtgctttgttcattgagtcttgcaactccattagtgattcaaaacaaagtaaacctctgtccctatctctgtaggatagttgcagggaagcaatagcttgtgtctgtagaatgcacttgcttttactaagaggcagtaaggaactgtctcagtatgaaaatgtgcatatacagaacgaccatccgtttttggtgtaagcaaaggggaccatgtgtgcctgttgtgcactgtctgtgcagaactttcagaaactgtcagtgatgcacaaggacgtgtgtgtccagagaagagacgcctgtgcaggctttcctggcagtctataaaggggcgagctctgtctcagtccaggctttcccacccagggttcctctggggctctttcatctcattatgtctggctattgtgacatttagagtattcaggtgaatgccggttgctgccttggtgtggaagggacgtcgtcgcttttccaccctagaatgacctttgatcttacctgtcaggacgtgatctaggcatcaaagccaccagttcccagaacgtcacctgcgaccagcataggtctgtgtctctgggttgttttggagaatatggagccttttgagatgcattagcagaagtctttttggtctgactgtgtgagattatatgtgcatgcatcaggggcttttttcacccaaattgcaaagattcccagtatttagagattagatgtggttagaaaagtgcatttccagtatgcaattgtaaagcaggaaaaacctaaagctttcaaaaagagagggcaaggcaggctggaggaggtgttcagagctggttttgctgaacttttgggcctggggaaggttccaccagtgtcctggctcttgggcttcatctctcgcagcagatctgcacagctccaactgggctatcagtgctgtgggcctcggtccaggaggctgggtggatgctgggaaggggatggagggaggacatgttgccaggtgatggtggctggctctacatgcccctgctcctggagaagccctggtgccatgtttctccctggctctggcttcctgtctatcacaggaggaacacaggtgtgatgtcagtgtgatcttcactacacacagcctttaacaaggtagcccatgacatggagagaacttatcactcctcttagagatttcctctgcttttctgttttaaatagactttctgttttagagcagttttaggttcacagcaagattgagcagaaggtacagagaattcccatagacctcctgccccgcccccatgtgcagcctttccatcagcatcagccaccagagtggtgtcacattagggtttactcttggtgttggacattccacgggtttggacaaatctataatgcgatgtatccaccattagagtttcacactcagtactttccctgcccttaaaaatccatgtgctctatctggttatccctccctggcctcaccctctggctgccgtgggtctttgtactgtcgctgtagttctgcgttctccagaacatcatacagttggaagtatacagtgcgtagccttttcagactggcttctctctcttagtaattcatgtttgaggttcctccatgtcttttcatggcttcatagttgatttctttttatcactgaataacactccattgtctgggtggaccccagtttgtttatccactcacctcctgaggctatcttggtggcttccgcattctggcagttatgaataaagctgctctaaactttcatgagtgggtttctcatgaaatgttttcatgagatgtaagtttcatgaaatgttttgtggatgtaagttttcatggtgttggggttttcgggaccccagcttacctcccacccggatggaatctcctagtgtagcatttcctgcttgtgcacagatagcgtcaagtcttgcccatggtgacagggcgacagcaatgcctgtccctgagggggcgtctgtgggcaggtgggcaggtgccgccccagccccagggggtggaggagagtccagaggtctggggctctttttccctgttagcgctcagaagggacactgtctactccatgctggggaggcccagccccccaccctgctcttcccctgggtctgggaggcatagctctggcagcagccccgttcacagcagggacttggttctaggtctcgttctgccgggcctgcctcatctctttccctgctccttctgaggtacagaacagtcaaagtccaccttggtttctgtgacttgctgggcctggaaaaagagaactggctgagtttaaatgacttcaggtacataaatattagttgctgcagtttctccaccacggaatcacagtgaggtcagtgtggagtgcgagggtgcctccctgtgaacaggcttctgctcgtgagtgcctttgtagtgtcctggtgctaactggggatgtatcctaggactttaagaactagcgcatccgtcttgggtcaggtttctcaggaaggcacataactggagtcccagccaagaggaaagatgtatgtggccagcagcagctcgctggctgcaccgctgaggggactcgcacaactctgccgcttgtcctgatggattctgtggcaaaggccaaggatggcctgcatctgaacggaaggccaggcattaaaaagcaaagggcagggaggatcatcgtgatcctttctctcctctgtttttctaagccatgagcacgctgaatttcagtacgcaaaaaaaaaaagccccctttaagcagaaaaaccattctagggacattgagagactagaaatccttgcctaatttcagattaagcaaaacataagcatttggcaaatgccgagattgtaaagttgtgcaagcagaagaatcactttgaaatttgagcgcagccccagatgttcgggagcatttccatgcgactgctcctcctagcgtgactggctggtgcctcccggcccccagcccggtccccagtgcttgtcctctgcccactcgctgcacagacctggggtgaggaagaaatgccgccgagcgccagaagattaggagggaattgtgtgaggcctcctctcaaagccagggtggctctcggcatacgcgtttatctgagtgactgaatcatagcacaatcattttggcgaccgtgggataaacgctgtgagagaactgtggtttgtccttgcgggtgtgttggttcaaagtcatgtgagtagagccagctcctgaggggatcgtctcatgctcacactgggggcagcatttgtctcttgtcagctgtgagatcagagtcctagggaagccagaatggtctctcagatcatgccctggccagaatccggggctgccctggccagccgccagatactgacccttctggtctcatccaatctaaagacaaagcatgaaagcccagccctgacgagctctggcctgaggccacccatccactcagaggcagacattggcttggagaagaaagagggatgaacttctggaaccaaagccagctggaattccttgcctctggtaggtgagccaagtgaattcaatatgtaatgaaactgtacttcataacttccctgagaacatttgtatttcaagtgtctgtcccagaacagatcaaagccctctgctaactgggattacagatgggaaaggagtggctctccatcgatcctggtgtttgtatcctgcctggaacagctcactttagggacagcagctgcttgtaggtgtctgcagaagaggcactcccatctctgcctagatgggggcatggcttagtaactctccagtaccctgttcttggctgtcgccctgtatatgccagatagtgacagtggcatcgttttgcaggaccaagtgttaagcttgctgcattttttggagttgagaaagagttggttcctggcatcgtgatatgaactctacatttatttcccctcttcctaagccagtgcaggttagttgactgcaaagagacaatgtcctgagctgtgtctgcctgtgggctcagtggggtcccggggatcacccaggcatccttttcagcctgctgggctgaaagcttggatttacaagtgattcgttttcttactcttgcacttctgctggggtagtgacggtggtcaagagaaacacatgttagtacagatgtgtattctgagtgagagggggctcacagggctgaaaacaagcccagtggggctcgttccagaacagaaagccccacactcccccatcttctcttatcatccctgttgtttttaaacattccccttatcatctcctcctctctttttaaagtgtgcgatcttgaagagtgccgtgccggagccaaatggtgtgggcaggtgcagcctgcctgcccccagcctgtccaggccgtgtgtggctgtttcccttcactgcccagtccaatctggagctttttccagccaaacaaaggcacctctgtccccttagaggaaagagagccagtaggagtatcagcccatttgccctgcatttgggacctagaaatcccccggtggttacatctggggtccctccttgcaggggcaaggtgaacgagctgctgtgagaagtaagagaagtcagagtgggtgatggagagtggggggtgctattctggaggttcccagctggagctgtttccattctaggtcttcacggagctacttcctcgaagctgggggtggcctcttatggtcccttccttaggcctggaaccaagtcctactagtgctcctgtaaagcctgtagaagcaacacaactcttctctcaccccagttctcatggccgtcacagccctcggcttgcctctgctcggctcattgactctaattccatttttgagggctgctttccgggcagaggagggcggtgggaatgagagcagaggtttccttcctgttctctgcacagcagccagtggccacctggactagagagggaggtacaggccctcaccctttcccaagcccacctgagcagcaggtacaacgtttgatctcaccacagtgagtgcaaaaccatccttcctgctggaaccaccgcaggcgcccatcctcggcagtgagccacaacttcctcctcacgtcttcttaaccaaggccagttataccctttcatgctcaaagggaggctgtcctacctgctggatacatgtttgttatctgggagaagtttaggcctctccccacctaatcagaatgtctaaaccctctgcttactaggtcaccaaaatcagtgctggattccagctctataacacccaatatgcacaactgttgttcttgtaaaattactggcattcctcttctgtaaagatatcagccccgcagatgaacagacaagtaaacaacgtcaggcagatgaactttctgctgggagaaaataaaactcgaggcacattgctttgcttgctgtacatggacaggcagagtggtcagatggaatggccatggattcgggcaccagaccaagattcaaatccctgccctacgatactcatcacctgggttaaccttctgaaccacaaacacttcatctgtaaagtgatggtaatattgccatcttgcagggttttaggatatggattagattgtatgtaaggcatctacatacctacatagattgttccatgggagctcaaaaatggctgctcttactgataacttatagacatgtaagtaatgattactactgataatgattagtgataagtagtattcatggaagaaagactcacggacacacaagacgccatgtgcatggatgcacctctcaaacgcttctttgcagctcttcacattctttgaggtatgcagtcagtaatagaactcaaaccttatatcctcggattcacttttaattaggctgttctcattaaaacgccattcctttattgtcttgccacttaatttagtaaattggtagagcaaatgtggcatgcagattgcctcttccataccagaacgtcatcattcattgccaaagcctatgtggattaggagcatttgaagtggaaattagttgagttcagggcatacagttgttgaattttgattatcagcttatagtatttttaaaattagattatgctttgtttccatttaacaaaggaagataaatgttgtggttgatgtttttattaaaatagaaatttaacaaacattctccaataactggatggattacaggagatgagacaatcaatagaggattacattttgcaaagccaatttaggaaccttgtctagataaaaccctcttgtggcagaagggatctggcaaaaatgaataaatttgtaataagtgtcaaccctggccccctgccgtgcaactcaagtatagacagatttttggagggaagatctacttccaactactgttattctgctagagagatgtgttcgcgagggattggtcacattttgacatcagaggctggccatgacaatcccaaggttctgccaaattccagtggattcccactgcttacttcaagtcccagtgtggtcaggacttcaggacttctctgaaggggagatggggcccttttctggaggatcagagctctgaagatgattggtcctcgttattcagtatgaaagcaaataccacatttcaagaagtggatggctctttttaaaataagtcaccttggcaactggaaggcacagcaaggagcgagaaagggtaagggagagaagcggggagagggaaagaatgaggaaagggaaaaagaagggtaaggagtaagggggaggaagagagagacaagacacggatacacaggagactcagcgccccttcaagcattctggaatcccccgaataatcaccactccttctcccttcttgctggaactttgtgtattttgcatttcctgttgaagtcataaatccagatcctgctctgtaaacccatggagtctgagggcagccagggccggcagaggcagaacatttcaacatgtgccgaaatgttcccacaggcagactaggcagttggggtggcaggaatccaggagcctgaactaggaggcgggtgagttgtctttgcctgagagttgagcttaaatcagccaataaaattgtccatcttaaggaagctgaaatttctaaataagcctataaataatttcacaaatagggcctgtgctgtgtaatagtgtgcactgattttgagagttactgcaagaataaatttgctgaatgaataaatctgcagtagtcgccagtcaaatgtcaaaggctggtctccagcagaaataaccttttaaaaaggactcattagctgagcacacagggcacccacataagtgatttctaattcattaagaggtagatgatcagctcatattttgcttttccagcaaataaggattcaaataagaacccttctccaactcagaaatcaggcttctggtgcctgcaaatctccccacatcaggatatgggcagacagctttattgctatcaattaaagttccatgcacaaaccttgtaatgttaagatgaggccaagaggtggcttttccctggctagattggaatttagtgagagtgggcaggcaatataaagaggccaaatctgactgtgggcaaggctgctgagctgtgttgcagagggattttcttatacccctaggtggtctcgttgaaatgttttatcagagacaggagggagcttgcagactttgtggggcttctgcttttgccactgtgcccgggctcccagcatatgctccagagagaggcctcggcttccagagacaatgcaatgggtgggaaggggaggtgtgtatttctagagtgggaaggagggccgggggccatcaggaccctctggctcatcaggtcttgggctgggagtcattgggtgtatagcaggcactgactggcacaggggcaagtgtctatgaagcaggtgacacagaggaagacaaactgaagaagatacctgtatgactccagctataggatccacatattcaccacaatgggcatttgtgtaaatgaagaatcacaaacacacatatgcacatactatcccaaagaatattcagtgagatttagaaaaacaaccaacccaagtgcattctctgttagtgattggtagcatgctgtccctctccaggaagaatattgtaggtagtggtagatggggcataagtctgagcccccagcgaagcttgaactcagctgaatgtgcatctgcactggggctggagactcctgatgtgcatggggttttggtgaggttgagctgtgtgtccgccaagctccctgagcctgtgcctcgaggagataaggtgaaggtggcctgctcttccaccctcctgtaagagtgggcatgaggatgcttctctaagctgtcaacatgttttatagatgttaattatttttgttattttaggtctccaaatatttcagagtgctaatcttttagcttttcttatgtttttatctttttaaaagtaatttgtagtatagtgacagagctgtgcaaccaccatcactgtctaatttcagaaactttccatcactgtaaaaagaaatgccatacctatcagtagtcactctctgttccccttcccccagcccctggaaaacactaatgtaatttctgtccctgtggatctttctttctggacatttctatgaatggaagcagataatatgtggccttttgtgtcttacttctttcacttagcataatattttcaaggttcgtcttggttgtagcatgtttcactacttcatgtttttatggctgaataataatccattgtgtggctagaccacattttgcttataccattaatcagtggatggacatctgggatgttctcactttttcaccatcacaggtagtgccctgtgactattgatgtacaagttttttgtggacaggtttccactgctctaggagtaggggtactgggtcgcatggtaactctctttaaccttctgaggggctgccaggcagttgttccaagtggctgcaccattttccattcccaccggcaatgtatgacattccagtttctccacatctttgtcaacattcattattgccagtctttgtgattttagccatcctagtggatgtgaagtagttttgattaatcttttagattttaaaataataatgaaagttacaactgtcatcttaatagaaggaaaaccaggttgatgatctgttgactaatatttgcaaagtgctaataagccctttgaagacagtatttgaagaaggcgaagttgatcctttctcctggaactcctttctcctggatcccaaagctgtggatccctgctggtagtaaagtagatgaaattagaattgctgcataagcgccaaatgacttgaaggagagcatgaatgtccagacggggatagagaccaactatgaatctgcctgtaactccaaggacagtactctccgtccctctccttgaggtgtgtgcaagcacgcacgctggcacactgtctcctggaaggaacggtggagctgtcgcttccccaaaccctctcctcttgccattcctatacagtaatgactagtatagacaaatacaatcacacagttttggcaaggaaaagtttgttctgggagaggcctttggcttgcgtaagagatgtttttaaaatgtgtgtggtttttgtgtcttgtttttcctagaggctagaagggaggatgccatggctctgacaaggcccaagaggtcagggaggggtcccttggccacatttcctctgcagtgctcggaaacaactcactggtctttaattttctgtgaagatcagtgtctcacttcatccctccagctggcatggctggagtcaaagtgagtcggtttacacagagtaagccaagaaatcgtagaatcccaggagtcattggatttcagggactgccatttaatttctttctttctttctttctttttttttttttttttttttttttttggagaccaggtcttgctctgtcactcaggctggagtacagtggtgtgatcatggctcactgtaatctcaaaccctgggctctagcagtcctcccacttcagcctcctgagtagatgggactacaggcatgtgccaccatgtacagcatatcatttcctttcttggttccccgcttcccccagtgacacagcccctttacaacatcccttaatatggctgctctgagtctgctttaatccaaaacagttacagaactcactcaccacttcccaaagcagcctgttccattctcagcactgatcgctagaaggttcttttctatatgcccactcatctcctggtttccaagccaggcatcactacatgttccttggaatgtcctgcagactctaccagcctggagtagtgtgtaggggttcaggtgcctgctgcaccctccttattactgcagggcaaagatgctggcccgagcagggaccacacctccctttgttccaaatcactcctgggaaaaagttcagagagggttgaaagtatgcatagtgtttccattagaaatgaatagtctttctgctttatttttaatgatattttcactgtgaaccgtaacgtatatgtcatgtttaaagaagaacaacaacaaacattagtatatctaccatcagcctaagaaatgtggagacctagaggccctccaggggtatcctgggcgtatgccacattttctccaccatggtaaaacatttaaggacacacacgtatgtgggtctacattgtttatttgattttatctatctgttcttggtgctgaatattacagatttagcctcagaaggtgtttttctgtaacttgcttcttccacccaacaaggaatcagctgtgttgatgtacatagatgtcgctcatttgtttttttatgtagtgtacagtttttcatggatctgagtatatcatagactatctacttcacagttaatgggtatttcagttgttgttgttctttttttttaatgttcatgtagaagtacatccttaccctggagaatactatgttctttggaacaggatggcttggcgatcaggcagcactttgcactcctaccagcagtggtgagagacgtttccttctgcgcccttgccgacacttgctgttgccagacttttaaatttttgccaatctggtgggtgtgaaatggcatctcattgtggtttaatttgcagttcttggattaccaatgctgttgagtcacttttcaggtctttggggaccatttgtgttcatagccttttctacaatgcctgtttaagttaacttatctttttcttgaaagatctatctgttcttgaagatagatgggtagttcttacctggtgtttactgccactgttctaagtggttctggatacagtaactgtttcagtccttcccaataaagtaggttttcttagggggacgcctgtctcatgggagagtatccgtaggtgcgcacagccactggcccagtgttccccagcaggtgaggggagagcaggggctcacacctgagcacgctggctctaccattcggttccagttcaactgctgggttattgacatattttggatgctaataccttgtttctgcaatgtgttgttaatatcttctgtttatggattgtctttttccttcgtatttaatgtcttttgataaatggaaggtttttaaaaacatttaaatgttgttccactgaacatttatggtcagtgttttgtgtcttatttaaaaatcatttcctaccctggagctttttattaacttttaaaagttttatagttttgcttttcacatttaagatgttaattcagctagaaataatattgtatataggatgaggtggaggacaatttctttttccatctagataacctaacttgccaacaccattgattaaacagcccagcctttccctgccgctggtaaatcacatcatctgcacatgtttgtgtctggaccctcccttcagttccatcggtctatttgtctattgttgattaaactattcttttgtaattactgtaacttatttaaagctttgatattttagcagggcaaggactttcactcttccacatacattttaaatcaatttgtcaagtactttgtcaagtacttgaaaatcccgtcgagatttaaattggaaatgcatttgaactatacatcaagttgggagaaaattacagcttttctgagtcctcttactcaagaacatcatatttcttgcaatttatttaggccatctttaatatcttttagtaaaattgcataatatcctccataaaggaaatgtacatgtttggttaaatttctacctagtaccacttaaaatagcaacaaaaatataaagtatttttaattatatattttagctacttgtgcatggtagatagaaaagcagttgacttttacatatacataccacttcccagtgttcctgttttcatgtttgccctttgcataaattttcttttgtgtcagtttagcaattcatttctttttcttgttattatggataccttcaaacatacacaatcatggagggtctaggacaatgaccctgtgtcaggcgatatccagcatcagcagctgtcaacatggtgccaagcttattccatatgtccctccactttttttgttttttggggaatcctttaaagaaaatcccaggcatcatattattttatccttcaatatttcagtatgtattaccaacagatgaagtcttaaaacaaaaaacagccaaaccattgtcacactgtcagaattaacagtagttgcctgatattagtccatgtgtggatttccctcatagtctctaaaatgtctttttatgcttgttttgttcaaacctggattcaaataaggtccactcatggcataggattccatctctcttacttctttctatttctggaagttcctactcttttccacctatttccttcatgccattaatctgttgaagaacatagtccctttccctggagagctgccccacccttgactatgtgggctgcatcctcatggtgctgtctcccctgctcctccattccctgtatttcctgtaaactggtagttacatctgaggacttggctagattcatttgtttacacatgtttgtttttctaagaacactttctaggtggggctgtgagcctctgatttcgacagtgcattcagaatcatctttgtactttctaatctagcgttccaggttatccaggatgcctaggtcatggtactgatataggaagggaattccagaaacagcgtgggatgatgccattcaccattgtatgctcctggtcatcactgtgtcctgtgatctgtcagtatggtcttcctctcccccacatttgtgtgtgtgaaccacagtggttcatgaccactttggtggcaggaacatgaaaatatttcacctgaacacagtgttatccagaggtggaatgtctgagtgtcaaatatatccctggactcccagttgccttctccatgctctgagcagggctgagagctgaggcttccctggggttgttaacggggtggtcatgacaagcttggccacgtccttcctcccacgtcctggtggctgctctgtggtcttcttgaggaattggccatgtgtccacagaggcagtcatcttagtccagtggcctggaatcctctcacatttcttctgggaatatttatctcttccttttcttactctttcatctccaaatgttcccctctctcctacattggtttctctcgtgtggtttctctgcgcatttgtttggtgttccctctgtgctcagccttctcctggttttcccaattaccaggtccagtctctgaccagaccccatgaagcctggttgattgcttctaaatctctccatctgagaaacatcctggagatgtggaaaaaaacacaactcatgagaggaaaagacttttgcattgagagcaaatccgcatgaggaaaaagtcaagccccaaagaatcaagtggacctgcaggtggggttattcaccaagactttttcaatgagatgtaaatcagtggcttcaaatggttccagaggccatggctggagcggtgtctttccctctgtgctggctggagaacaactgaacacatccccccattctcccttccctgcactggggtgcagccttcctgcagcaagtttcagaggtggaaggctgatgataagtctggagctgacaggcctccctcaagggaggacactttagcagagagatttgcacatttctagaggctgcaagagggcagtgctcagcttgatttagagccaagaagtaagaaagcaggaggaaggtgaaatgaattgcaggagtgtgacacaaaggaggctggagatgccttttcttacataggcccagcctcactttcagcccaccttcaacccagcttcagccagttttgtaaggtttggaactgcacaagagagaaataaaagttatatgaatgtgaatggtttccaaaagtctctctgcagaacctcttaactttaggtgcagataaactgcaactttcttcaatgggttcttggacccctagtcatggtgacagtttgactagcattgagagaatgttgaccagaaaaagtcaacatccctggcccttacaaaacattgaatttcatctaagtggagtaaatggtttaaaagtttaaaacatgtaatgaaatatatgtagcacgggcatgcatttcctttgctcccactctggggcagctgtgagatacttagagggaacatgctggaaggaatgtcttctgcccagtgtctgtcccactggaatgtgtggtaagtctccccaactctgtgggttgcagaaagaagaatgttgccttttcctcaattttggtgtgcatttcagatgttattgcgaaactaaagaaaaggggcaaaattcttctcttgtgcctatctctctccgtctcttccttcttttttttttcttgtcttggcatatctcagaattatccaagactttcatcctgttgattattccttagtcatgtatattcgatacattatgactctaaataaacattccatcttccttacgaactttgtaagaatggggggcagggggtgtccccccttgtattgttagatgtctagtacctcacacaggcctggcacagacaagatagtcactgtttgcatgggtggatggatggatgcatggtgggtcaatgggtgtgtggtggatggatggagggagagacggaagggagggatgatagattgaggagtgatggatggatggatgaatgatggatggatacatgacggatggatgaataaacaaataaatggagagatgggtggataaagataattcaaatacatacacagatacacaactggacaccatcattccccacacactcctaaagaggtgtgtgtcttctccccctgggtttcatcaataagcaggatccctcttaagggaccaattcctctggtaagggtctgcaagtcactcatctgtgtctggcaccttgcacagtgtgtgcagtggaagtccccagcaagtgtgtgttgaataaaggttgtgccatgcattagttcatggtctaagtccatataaaaagccaggtgtttggagttactgtagtatctgttgactttcacccaaaatctaaaaaagactcctcagcttttccttccagcatagcagaagctcttccaagatggccaggagataaactcaaaagcggtttcattcttccccatcctttacttttggatctgttccctggagcatggggaatgccgggtgtcttatttcttgaagctgaaatttcctgatattgtgtacagacccccacccgcctgtcccgcagggctgggtgccagagcaagattcaggaattggccatcaaatgagttcctcatttgcaatcaattaacagccacctggcctgttttcctgcctccctcctctccccttctctctctccccttgttttgcatcatgaactgattggagtgtgagaactggggccttaaccaggtttgcaacttctccctgccaggagcactttctcccaaaacctcagggctcccgcgtctactccttcaggccctttctcaccctcctgaatttaaaattgcaacccccaccgccttccaatccccttctggatatattttctctggagtacttacggtcttcactatactacgtacttttaatagtttattttgtgtatgtctctgtccccttataaagtgtatgctcccttaaggtagagatgtttttatctattttgtttctattttctttatctattttgttagttcctagaaccatgtctggcacatattaggtggccaataagtacttggtgactgattgaatgaatataatattaagatgattttttaaaagtctcgtgttcagatctttgccaggggcaccctgtcatgcccctggggtctcccctgaggagagacctctcaccagaggagctgcagtccactgcctctctggaggggtttgcctgcaccctcagcacctggccgatcctccgatgggtcttcctggtgctgtgactgtctgtgactagtcgtggatgccggctgagcctgggagcagcggttaccggaaatctgtggctttctgctttagctaaagagagaagactgcatgtgtttgccagtcttttgggtgcttctgtttagcatagacattggccaaggctgctggtaaagagcaccagagaggcgctttacccatgagagggaagcatctgcggcccggagccctctgcaagctgcctcatgggacccctaacagaccttcttgcctctctgagttcagggtagaaacaacctgctgatccgtctgtttccctctggcacgccaactctctcctgagagagctcctcctcctgattctgtgttctgagagttgcgcccaggggtgctgcacttgctccttccttctcagcctgtagctcagctctgacactcccgcgactcccccagcaccccgagcagggtgcaggtcttcctggacgggcttggggctgagtgcagcagaagcagcacaaggctcctttgctgcctctgcccctaaggagtcccaggatgtgtgaggaacagagctttctcctgtcccgagctccccgcagttcagccctctctggactagacagttctgcatttcttagctcactgtgctgtgctaaggaagccagggctgccccgtgggtggaacatcctctaatttgccaggcaggaaaggatggggcgatgagtcacccttctgagtgattcctgccgagcttcctacagaacatatccaggagcagccaccccgcccccagggttagtgtgtggaggcacaggtgctagtgtgggtggtgagaaataggactcggaatcaccctttttaacgtgcacagtatgttaattgtgtcctcacaaaagtgttgaagtgtttcttgccttatagaataaatggtcagaaaccagtggattcctttgagctgttttgatgggaggaaattaactgtgacagtgagaccttggtggtcccaacatcagcaggatgcagaagacagcctagcctgctgggtcatgtattcgtcttcggcagcctgggattgggaatgcgcgtgagtgcagagctgctcactgcctggtgccctgcagctccagtgctgcctcagtgcgttccaggagagacctcagtttccagccctagctcaagtcccagggttgatcttgctcgcggcagcaccaggcctgcacctcggaaaggcatgatggacttacctgtatctatcaggttcaggcattctcctgcctgtagttgagaattcaagttcagggtgattagtttcgccttttaaaagagccctagcatatccttgctggatatattcattgctgaaatgcacaagaaactgaatgtgatcaatgtaatgtattggtttcagcatcagatgttaagaaagtgaatctgttgagattcttgcttttaaaaacacaaaataaaacaagcctaaccttagtcagtcatcctggacttgagatcacatttcacagtctacaaagtgaggtttcacgtatagcataccccacctgtttgtgtaagtaaagttttattggaacacaatctcacccactaatttacatggaatctctggagctctggctgctacaatggcagagttgaatagttacagctaacactgatggcctgcaaagccaccttgctccactagagacaaagtttgctgaccgctggcatagaagataagagcacaaattctgaaaccaaactgctagagtttaaatcccagctctgccacgtattggcagcatgaccttgaacatgttaattaacctctgtgtgacttagtttcctccactgtaaaatggagataatatggagataataatatctccattataatattaataattataattatgatgatataataatgatatcaccaaaataatacttgtctcctaaggttgctatgaagttcagaagaattaataatgaggacatgctcagagtactttctgacaagtggtaatgtgttaaatttttaaggaagtgggcaggtttctaagactttaggaaagtccagtcgcttcctcaaatcacagacagttgtgcatttgaagatcacctcaaaaccaggttcagaggctcacgcctataatcccagcgctttgggaggccaaagtgggaggactgtttgagcccacaagttcagcctgggctgtaacatggtgagaccccgtccctacaaaaaaatagaaaaaattagccaggtgtggtggcatgcacctgtagtctcagctactcgaggggctgaggtgggaggattgcttgagcccaggaagtcaaggcttcagtgagccatgatcacaccactcgacttcagattgggtgacagttttttttttttcctttaaaaaaaaaaaaaaaaaaatcttaaaaaaaaataaagaccacctcatcatcagggtacctcccataggaaacacagccttgtgggtgtcttggcttcctgttggtccagaaccctgcggactttcctcgcaataagggcacagactggcttggctaaaggaagggtgctagtggtgccagccagcaggggaaccctcacccgctccggggatgccagggatggagtgaggcagccacagtgtccactgcgctgattccagcaggggatggcagcatggtgacaggaagtcacacttaataatgcagacaagagggaaaggagacccacagacacagggagaaaaagctgcaatatgcctcttcaactcatgagaacaggaggcgatgggccacagaggctgctgaaggagtttgttcctgcctctgtttttctctctccttctccaactagaatgttatgtgccacttgctcccctcagtagcacttccaggacaggtggactacatatttgtggaacccagtgtttttattgagaagccttctttttgctttttaggctggccttcctggaaaggttctgcttttaactctttgcgtgccttcccaggccatgcgtcctggtgcgaggctctgagaacgcgatttatgtcaccgcgttggcgacttacatgtgctccctgatcattgaagacacggttttgtctctgcctgggatcatggtggtcataccactccctgcttcaaaaccgaacatttcgtgttttcggagcagattcgtcaggacgttttgcagcatcctggggtgttacctgttccttgcgcctgatctagagttccgaggcctacgcacctcagaggagcagctgtggggactgtggggcaaggcccctcgcccgtcccacacgagaacggctctttctagcatgttttctcaggtgtctctttatcctctccctatgcctcaagtttccacattgaaaactctcaatggcgtttatttccttctgagtctctgctgggctgttccagcccttccacagcccctaccctgggaagcccgtacctcttccacacgccacctcctctctgcccctcagggctgggacatgctcgtcgactagccctcgctcatccacgtgtccctcagttaccttctcgatgatgacgttctaagatttcaccctatccccatcccagtgttcatgtcccctcccctggtttatgtgtccccttagcacttaaccactttctgacattctctagattttacttatttgtatgttttgttgctgtccccctggctggaacataaactccacccgggtggggacctctgagtgttttgttcactcccaaaccccacgccagaaccgcaccccacaagtaacgggcactcattccgatttgctgactaactgcataaatgtcctaaaaccacttcctaccttacgcggctgtagagaggataagaatgaaagttaaataaagcctatgaaaatgcttagaaaacttgaaagcataaagtgaatgtgaaagatgtatttatgaatgaagcagctcaacaaaaaaagacacttgggggctgggagtgggatatgtcggtgagactgatagcacgatgttgtcgagacattcgggctgatttaagtgactggcaacatctggaacccatcaggaaaagctttagcgtagaaggcattcctctccctacattttgaaaattcaggcaggcctagtaagctctttaatattttaggaagttcaaaaatatttaatatcttaaagaaagtcaaaaatacttactactctgggaagttcaaaaatcaccacgtgcctagaagctggcctgcaggagaaggattctccctcactggggaagaggtgtcatgctgggaaggctgtcttgttctctagactaggtaaaatgacaaccaaagacccatttttactttaaaatgagtttacaaagccacattaaagtgtgaaggcttcaagaaggaatttctcacagatagaacagaaaataactggattgactcactagcatgcaaaatacatttggaagggaagctgccaccaataagtttctcccttgggtacaaagaaatgtcctggtgtgcccacggctagcacgtgctgaggactcgctgtgaggccccgtgtaccccgcaggctgctcttgaaggaaccagtttccaagggaggaggatgatgccagccctgggcagtgtttccaccacgttgaggcaaatgctctttgcagcaaaccaggagagcatttgtttgtttctctgcagtgagactatttgcattaataacttacttatgaagtttaccttaagtctgtaaaagcaactgcaacatccaattttgtggagatttccattacaaagttggcaaagcgttttgtaactaaatatctggagttaaggatttatataaatcaacatggaaatggggtgccgagggaccctctcctgctccaaccgtatccgtcaacacctggtgcagtgaagaattctgctcagttcctcctgtcccagagcaaagggcagtctgcatccctgacagccagaccatcatcctctgtgggcagcaaattgcagaattagtgtaaagcagacaaatgcaatatctatgtgaaataagcccaaatcattaggtatgctttgattcaggcttaacattttttaacataatagcaaaccgtatttagtatcctaaatgtaaattcaggacttgtagttttcacatttttgtgttatgtatcttaaatgcctttctagagagggaggtacgaactggctcatagggtgattttttcctgagattggccacatgatttaaagatttgtaaaagcctttggacctatctgtattgagaggtaagagcttgggctcccttggtcctgggaccctctcctctccccacagcagggctgccgggagccctgggtgcagggtgcatcgggctgctggccccattgtggccctgctcccatctgtcctgtaacttctctgcatccaaggctaggtcctcctgtgtgtggtgtccttagcgccttgcactgtggccaccccctcgcatatggcgaaatgttttcctcaaatggtgataagggactgtgcaggcaagggcgggagtcctggaggcacccccggtcacaggatcaccctcagcgtttccaccctgcccaagaggtctgtggagcttccccgagcctttagcacatttgctaggaagtccatcctccattggtggaataaccttcctttttagaaccttcttgaatggctgtgccatatgctatcagcatatgccgtatgctaccaggtgggttatcttggtggtcaagtttgttttgctaaggtccccctttttttttgagacagggtttcactctgtcacccaaactggactgcagtggcataatcatagctcagtgcagcctcaacctgctgggctcaagtgatcctcccacctcagcctcccgagtagctgggactgcaggcatgcaccaccacgcctggctaatttttgtattttttttttgtagagatgggattttgccacgttaccccggctggtctggaactcctgagttcaagtgatctgcctgctgcggcctcccaaagtgttgggattacaggcgtgagccaccgcgcccaggctccttctgtttttgatggagcttgccagtctgtgtgtcatgtgatgtggagaactttagtaaacacgctgtgtgctgctgtctggtagcttcccgagtcggaagttatttgctaccaacaggagaccatcctttggtacttacagtgtgccaggcactgttaggagtaactcatctgtattaactcattcgatctcacatttaggatccctgtgagacagatacttagcacgcttgttttgcaggtacggaaactgaggcatggagcaggcagggtgtggcagaattgagctcttctgcaagaagcttcatggccaccctcaaaactccttgagcgctggggacccagttctaacacaggcctccttccttttgtcatttgagccagattcttagggaaactttttttttttttacatgctcacagatactttattttttcttacctttttgtattacacttgacccttgaacaatgcaggagttagggcaacaacccccggcacagtcaaaaacctgtgtgtaactttttatttttattttttgagacagaacctcactctgttgcccagactggaatgcagtggtacgatcttggctcactgcaacctctgcctcccgagttcaggcagttctcctgcctcagcctcacaagtagctgtgactacaggcatgcgccaccacgcccgactaatttgtgtatttttagtagagatggagtttcaccatgttggccaggctggtctcgaactcttgacctcaggtgatccacccgcctcggcctcccaaagtgtgtgagccattgcgccaagtcttgcatgtaacttttgactccctcaaactcaactcctaagagcttactgttgaccagaagccttactgataacacaaacagttgatcaacacatatcttgggagaactatacattatatactgtgttcttagaataaagcgagctagagaaaagaaattgttatttaaaaaattgtaaggaagagaaaatgtatttactactcattaagtggaagtggatcatcataaaggtctacatcttcatcatcttcacgttgtgtgggctgaacaggaggaggggttggctttgctgtctcaggcagagaagaggtagaggaggtggacgggtaggcagagaagggaggcacactcggtataacttttattgaaaaaaatccacgtataagtagacccttgcagtttaaacccatgttggttcaagggtcagctgttttttgggggggtggggggtaacatgaaagtaatgacatgaaaaatgtatatatagtaagatgatgtggtggttggtttgggttgaaataaggacctacaaggaatcctctgcctttagtcccctccttctcttccctcctgtcctcttggtcttctgcggtggctggagatccaggtccccagtgcaaggccccattgacctgaggccacccacaaaggaggcccacgtgagtgtgctgcccaaaaggccggtggaaaggtggtagatggggccgaccaggcatcagctggattcaggccctggagggtgcctgggtggggctgcaggggttgccggtagcgaggcctttgttccctgggagggatcaaggagcacttttcaaggtgcctggtggctgctggggacttgctcaagtactcctctaagtacccattatcagaacatgcctgggaacactgcaaataccagctcacagcatgggatctcttcccagaaagtgaggaagtgagcaatgcatctctgaattggataaatgtaaacagatctggaccctcctggcccaacggatgactgacccacagctgccctttcccttccataattaaacagataattatcagggctccacagaggcttccctcgccttttgggggagtgaggaggaggcaggtggttggaagctggttgcccagttacacgctttgtgatgctgaggaatttgcccaccttgctacatttttctcacttataaaaggactataattcttatttcacaggagtcctgtgagcagtaatcgggttatcgggagtgtctggtggggagtagcagctaaataatggctgagttactttgagggggtgatgtgtgtagctggcagtgcacaggttgggaggtcagaccacctggatccagtcctgtctctcggaccttggacaagttactggacctcactgtgctccaatttcctatcggtaaagtgcagataatataaggccaagctcacagggttgctgtaaggatcctgtgggtctcgcaggtagaggtaggagcagcaggcacacaggaggtgctcaggacaggaaggggcaaggtctggatgagagccccagtactgctggaacccagagaagcacatacctcaaccctgagggtgagagaaggtttacacccaaggaccatgcattggttctttgctgaattcacttattcagtgaatatgggcagatgctggaggggcggtcctcagttctcccatctgacttttgctgcagtgcatgaggagggatcaccactgaccacttcctacacttagaagcatctgcctttcctggccccggcacccagggtcctggaacatctgtttgcctcagcaagtagtcaatgatcattgtttttatagctcctttttcattaagagacacaaagctcttttcgtatcatcagttttattctcagcatactaagaagcacggaagggcagatttgattatctctgctttatgggaaaactaagcccaaggtactttgtcaaaaggtgcattctaaggccaccacagatgacctaaccgctgctttgatgcaacagggaaacaggccacaacaaagtctgggaaaagtaaaaaaaggaagaaaaaaaaaatttgcttttaaatcctctccaatctggctgcaacatgaaaatgctacaggcagctcttagctgtagacaatttatgtcttcacagttgcatccacgcaacagcttagtagtggcctcgtcaccctgtgtttgaagggcaagtcgtgttttcatcctttgtcttatttcatcaattcttcatcaattcttggatgaatgagtgtgcaaatatgggaaaggaagaaactgacagaagaaaagaggggacaaaacaaaaagtttggacccaacaagcagctttgaatgagaaaaagggacaaaggaactcgaaatataattatctgtaaaacaaaaacctgggaacctctggttgcagtgtgataacagtaacaaacttcttcatcgcggattaaatctataaagtggaagatgggatacactctggtaaatgcattatttaaaataaggtaaggccaagagttgtgccttttctaaatctgagagtctctgagttgaaagtgcttttcaaagatgacagcacataaatgataaccctcaacagtgctatgaaagtcagtgccttggcttgaaaaatgcttacgagctaaagaaattgtaaatacacctgagacttcctgagtgagtcagaatataagctgagctgtgaatgagatcccaaaatgtgttggctcagataagatcaagtttcctttttcttacttcatggtatgggggtgtgttctgcaaggtcaccccaagacccaggtttcttccccctttgctctgggcataatatttgatggaaaaactggcccaccctactgtgtctaccatgcagcccgtgggaaggcagatttccttatgcatgtcatcataaaacatgctccagaatgtgcaggaatcactttcacttgcattctgtggacagaaatgtggacacctacccagggctgcctgcaggcaaggctggaaaatgaaggcttctgctggaagcttgatctcagttgaaatttggaatattctgacagacaaaagaagcagaaagtgggtatcaggggtcattagctgtctctgacccattctcagaccccgcagtgcttggtgtgtatacaattagggtctcacccgccggggcctatggacgaatgtgttcatcttcctgacacttttctgctggccacatgctgtgctatacaggtctggagactgcaggtgggcagactctgtgtccatctataactctgggcctttgcatgggctgagcccctggctggaatgccccacttctcatcagccatacctgggattttccccattccgccaggcccagctgctattagcaataggatcttgggcaacatggactgtgaatctcatattttgggaaaaataatgggccaaatagaggctgtgagccaaggccccagtcccaggggactggtttgctagtctgtgtgttcattcgttcagtagatatatggagcgtatgatctgtgtcaggccagcagcggagcatccaacagtgagcaaaacaggcgagaatctgtcctgatgggctaattgtgaagggggccctccattgaaagcaggtggtgagagccgtgacaagtgctctccttgaaagattgcatccttagggtcttaaacacagggagccggtgctccacgctctccaccccagcttgctgggaggtctggaataggccagttggggttgtgccctcccgacgctgcaggccgactctggcacccgcccttactcaggggtacggcttgcctgagagtcccaaccaggggtgtcaggagcacattcattagagcctgctgccacatgcctgattccagtagaagccggagatggcgccgttgtgcccacgtgagcgccatctccacgggtaggacattaagtccagaggaagatgtgtgtgccacatctgagtaatgagccatgaaattgacattataagttttaattattattaatgccttgcaggggtggctgatgttaattgtcctgtaggcatcccagatgggttttccttttttcttttatttctttttcttaatgtcttgagcccaaataatggcggcttagtgacaatgtttgaatggaattcctctgaaggggagcacgccgcagtgtgagaagttcttccaaacacgtctgtgggcagaaagcaaacaggctctggagcagctgcccaccctcctgggtgggtgtggaggctgggacatagaggcctccaggttgctgccgtgaaatcagcagaagtcttttctcccccataatagcatctgcctgccttaggccccttccatggactaattagttaatcttataaagggctttgaagatgaaagactctggaggtgccgggtgtcacccatgtgagcatttcctgatgagatccagtttctggctgcttctgctcctccaaataaactgcctctcggcatcttccttgactcttttttttttctttccctcagaaatgtgtcctgcatcttaaaaaggttcattccccctcttggttttgctctgtccaatctgagtctggcagtctgagatggggatacagggggctctcttgccttctctctcccaccttctctgtcccctacccttccccacttctcctcctggctcaccagccagcaaggcaaacaggccccacctgagcccccatgctctcacagcttgcttgctccgagaatcatgctctcagtaccagactcgagcccagcaggtgggttggggccagcaggtgggttaccacctgtggagaggtggccaggcgtacaatctccagtctgcccctgcttctgccctgctcctgccctggtttccttttttttttttttcttagacacaggttcttgccctgtcacctaggctggagtgcagtggtacgatcattgctcactgcagcctcgaactcccaggctcactcagttttcttgcctcagcctcccaatagctgagactacaggtacttgccaccatgcctatttttaaaaaatattatttttagagatagggtctcagcgtgttgcccaggctagccttaaactcctggcctcaagtgattttccatcctcagcctcccaaagtgctaagataataggcgtgagccaccatacccgtccccagatccttcttttgtaactttcccccctgtatccccatccaggcctgactcaggactaacctgagtgcctttgaattaacagcatatagaggggacctgctacgcagggagaacactcctgggtcctggggtcatcagagtgaacagcatagtctcttcctgggggccttagtggcgtagaagctaaggaattaggaaggtggccgatggagttaggatggctggtgagtggctgatgggtgctgatggaattaggagggcacaggtggtgacgggggagcagtgtggattttggagggagtgagaagggcagaggaagtagcatggagctctgtctgcaaagccctgcatgttccaggttccagaagcacagacttctcgtgactgaggatgctgtctgccgtggctgggcaggtatgctgaggccagcgtaggggacctcggctgccgtgccgaggagctcggatcccctgaggtcatcaggcagacactgaagctcataagcagcaggtgcatgagcttggccctgcatttgggcatccagcccatgacaggctgatgggccaggagaccactggaggaggtttgcactgggtgcaaggagagatgacaggcaaggcagtgggagtgggagggtgcacagccctctgggtgaaagctcagaagtggagttggcaggaggagtgcccaggccaagggaaagggtgggcacagggatgactgaaggtccttgccgagcagctgagtggggatttcatggccagaggaggtagggctggagggacagacagcctctaggagcttgcagatgtccagcagagccgtcaagcaggcatctgggttcacatcaagtcccatgatcagaggggacatcacaggcacaggttgatttgagagccactggcacagaggcaggtttagctggggtctgcatcagtgaaggggggtgtcagggaggcctgcaggccacagtgctgataccagtgaggccatggtccctctggagaattcatgaaagacagaatccccgtgactcaggagtgtgtgtctcgcagtgtctctgtcctgggtggtggcctacagccccaggctgcctggtggaagatgcctcagtctctctggctctgcaccccagctttacctgccacactacctaagttggggccgcagttacacaatgtgggtgtgagtggtgtcttcaggtggcctttatgtcaaccagtctagagaaggctgatggtggggaggccagaaaggaaacacagtgtccccttctcgggggcattgcagggagatgtgtgtgctcagatagcacgagccggccgcagaagggagtgcagcgtgtaggcaggtgcaaagctggcccttcctgcccactgttgttaccaatggtagcaaaagtcgccaaacagccaccgagtctgtagctcttataacacggcttttaagcctcacccttgtggtttgggaatgaagggaaatggagtcattccctgacagataaaggttttttgtgtgcatcttgttgaggctggtttttcaacttcagagcatgttcttttcttacatcccttcaaaactgctcgccttgatggatatctaagtgtctccatgtagccaatagtgaaaatactcccctcatgaaaataaatgttatatttaacttttaaagtattcgtagactaagttctattagaacagggaaccttactctgtcttttttgtaaatttaaccaaacaggctgggccagggtttcttaacctgctgatggctctgggccaggtcattctttgtggcagaggctgtcctgggcattgcagggtgtttggcagtgtccctggtctttacttgttacatgttggtagcaccccaccttccggttgtgatagccaaaaaatatcttcagaccaaattgtcccaaattaagattccctggctggcggctgagtggcccctgtgtggcagtggaattattctgatggcctgcagccaactgccccttcccattttttctgatcacagtgcttgtcttgcaaattaccccttgcctccgctctctaaaattggggctcgttacacactattgtgctcgcactacaaagctatccagaatgagtattattggaagcaaacggattttttttttctcttcgagttctgcaatgaaaaatcctctggtgttactgtttaattggttagtggtggctgtttgtcaatttgccagcaggctctctcttaactgctgtcgtttgacgttgctgaaacataaatgtagaatgattgagttgccaacatgctattaagtcctctacaaagagtttttcgatgtactactgcttcaggcttttgtgcttctattgattgattcgaatactgaagaactccttggcataggcagccctggtgagaaaatgcggcttctggtaggaaaatcgttgggtattgacacccgaacaatgcaaagctttcctttggttttcctctagcacaggattgacctctggcaaagctcccacagttgagcaggtattggccacccataaaggaaaaggagagaggcccatgaggccagatggacttgatgagacagggccagttagagaagcccaggaagtggaagaagacatcacatcagtttccggattctttgacaggctccttattgctgacaagcagaagcagcttagaatcttgtttggatttcagagctagtcacggtttgagaccgaggatggcagaacaggtgcagatgggttggttaacctctgacggatacaagaacatcactgttaggaggatacagtcttatgcccttgaacaattgtacttctggaacagactgctacaagtacatgcagcagaaagctgtgtgtcatggtgggggggtctgtgatggccggggactgcttgttagaacccctgctcctgggcatggcccctgtgctccacacaggctgtttgtcatcatcctcgtgtgtgtaccgctggccatgagtcctctgagtggaacgctcagcacgacggatgccatgcacgcctgctgctcagcttcaacccctggagcatgctcgagttgctgtgactattcagtagatgaagtaaagaaaaaatggttggatacttgctagaagtctggcagcttcttagactaaaatccctgagaaataggagccagtggaaaatgattcagcatagagtattgagtaagaaattccgagcccagacctcctgggttcagattctacctactgctcctaggtgtgggccttaggaaagtcaccttccctctctgtgcctcagtgtccccatctgtaaatgaagacaagccagcacctacttcagagtcctttttgcacagaatgaggttgtctgtgtggaaggcctcagacagtgtcctttttaggaggaatggctaggatggggaccctcttatctcagtggcgcctcagaatgtgcatgttcctgtgacaggctgtttctttaaaatattttccacttgcggggcactctgtatgcacccccaggacacagaaagcccctgagaagccccggcctgccccggcagatccactgtggggcattgggaaggggcatgcccggtgaccacatgctgtctgttgcttgcagaatccctgcctgcttccctatggcaaggccctctacagctacgaggggaaggaacctggtgacctcaagttcaacaagggggacatcatcgtcctgcggcgcaaggtggatgaacagtggtaccacggcgagctgcacggcacacagggcttcctcccagccagctatatccagtgcatccagcccttgccacacgccccgccccagggaaaagcactttatgatttcgagatgaaggacaaagaccaagacaaggactgtctgaccttcaccaaggtaaggtgagccccggggtgggccccgccagcccatgcagcctctgtgccacccagggctcttcccagccacagacctatagccagacagtctttcttcagagtctgaatcctggctcctcccggaaccctgggcaaatgacccagcctccctccctgtgcttccatgaatggggtgatggttttttttggttgaatgctatggagggcaccagcttgacacacagctccagcccagagctacataggagcttgagataatataagcctccatcagcaccaggagcagaaccctcagttaacctgagtcatggctctaagcgctgacccaggtgcagcagaatgacgcctttccaggactcttggggtcctgtgagaggggctcatcaggggaaactgctacagagaccctggtcagctcacagggagatgatagctggggtctcacatctgtgcatcacagccctgtcctctagggcacctgaggcagggccaccctggtgcgtagggatccctgtgaagcaaacatttgggagcaaacaaaatagcactgacaggtgaaattgagtaggagggttgggtgaggtgcagaagagactggttctggctgtcctggcagttgctgttgaataatcatctgcaccaagtgctcggccaataagctcacacttggtctttacagctgtcccaggttccaggggaagtagttggaacctcgttttctccatgtgtaaaccaaagctctgagaggctttgtaacttatccaggctgcttgctgggtcctctctccctcctgcttccccttcctcctttccatcttcatctcctgtctcttgtgtctcctccatcccctgccactgctgcacctgctccccgccgcccccagatgtaaatgacagagccagaatcctaatgcagatctctgatgttaacactcagcattcttcccacctccctacacagggaattcttcccttatgtcggcctcactgtattttagatgcccagaagttgttgttttctctctcctcactcgttctgtcttgcctgtgtctctctgtgtcagtatttctctctctctctctctcacacacacacgcacagagttgtaaataacagaactagaattctaactcgaatctctgcttctaaagcccacatccttcctgcctctgagaggccattgctctctcccccatctgctgagtgcagagctcgaggtggcactctctggagggcggtaggagaaccatgcacagtgtttttgagcaaaattggcatgtcctgcgtacagctgctatttatgtcttgttctattgttcagcctgacaatgaataatctatttttcattcagggattcaactccttctcccttccttttatcaaggtgttctgatgctaattccgattgtcatctggctgcacagcttcccgggaaactgcactggtgcctccctccctccccactcagtcggagggcgagagcaacagcttcctggggctatttttaggcacacagaaacccaacttgcttctctgcccagtggactcttccccctaagagaagacctgggaccactggtgccccaggtggtcactcatgaccaagagcagggacctctgaactctcagggtccggtcagggccttgctaaggagacagaccccataatggctctaggcttctccaggcttggcgggctccaggctgcagagccgaggccctcctccaggggcctcacaggaggaggctctccactcgggagaacccactgtgaacgggctgtcgcagggccctggagcctctgggtaggcctgcttctctgggcagaagtgactgcctgcctttcctgtcatcaccatataacctgctgcattccacgggcctctgcccaggatgtgcaaccccaggctgaaggctagagcccactggacaagaggacaaagggcacctgcccatttattccacagaaacataccgggccctgactctgtgtcgggtactagacctgctgctcttctggagcccagagtcaggtgcgggagacaggccagtggagaatgtgcagaagacaggccagaggctcacgagctgcatcggatcaccaggggcaggccgggcatttagtgtgggctcctgagtagtcagtgatggaattccatgttccatatttcacaagaaacagtgaaattagagccatcaggcttagactcattctgcggttggcatgtggggtgggggtagccgagcaggggtccatctgttcccaagtgggcaatgtcaccatggctgcccaggctctctggaaggtgacctcttggttgaattgaggtcagaggcgccagccacgggaggcccagcatctcctgttacaggatctgtgacggctcccacagcagacaagggggaagtgtcatatcacagattctttgttcaaggactttctttacttgaatcctgtgagttaatgtggagaattagaggcctctgggtgtgatccccagagggacttgtgctgtgacacgaccttcctgccatgctcctatgcccactttgaccctctgacccccaaagggcgaggtcgggcagagattggccacccctgctacctgttctgtcctgttgcatctctcactcctcagtgtccgcaaataaaggctccaagagacatgggcaactccatgtgactctccgctcagttcctgttttcccccacggtgggtccgacccaccttacttcccccatgcctggcatgcagctgagacgcacacactggctctgacaacctccatgtgaatcagacctccaggaaccaaatgattccagtgctgcagcgtaggtgctggttcatgccagcttggtctcccctctggggaatgtttttattctttggatatgttccattcctgagtcagagaggaaagaagggtctctgaaagctacaatggtataacctgcctttatacagcatcactgtggcagactgatggagtttaaattaggtggatcaaagcaagatttttacctttggtgtttgcttttgaatagtcctgttaaagtggcattaattaaagtccttctaaaatctagtttctgctttatttcagaagagaatgaataatcagtttttgtaaagcagctttaaaaagtgatattttattacttcttagtagcccgactccagaaagctgggcatgtgcaaataaaaagacgacaggcaggaagagctgtgggcccagctctgccagctggtttctgaggagcctccacacgtgctgggccagtcacccgggaggggctggccttggcagggccttgcagtgagggccccatgccagctgtgtgacttagggtgacacataacctttctgggccaggagcacctcgccttcccagtctcaggatgccagtgtgcactctgtggtgtgctgagaaccacatgatataaataaattgtggagcctagggctgggagtgcaggagaagaatgtgaactactccattgtttgagcagctaactctatattgtcttactcagctcacctgcaagattcggcaagggtttattgaacctcttctctgtaactttcagttaatgaaaacattgtggtcgccttgccaggcagctgcatttgctatgcagggcccacgctgcttttcatgagttccagctgggatgctcaggaatcctcagaggccacggggttttctcagagagtgcccgctgatcatggaatcacttttgcacatgactgcagcggggcccccaggcttgccatatcagccctaatccctaccaggtgtgccatgtgaaggagccacagggcttggtggctgcagccactgtgctgtcctaaccctcatctcaccctcgatttgtcctgatctggtcagaccttaagactcttccatgtgaccttcttatgctgctgaatgtttaatcatttctcaaaagtatgggaagtcttacctttgtgaattaacctagcattaattccaaactctgctcctctgatcctagggacagacatagatggataaaaatcaaatatagagttcaggctctagcatgaggtagacacagattcaaatcatggcacgtttctttaataatgcatggtgactcgaacatttacttagtgtttgagttgctttttttaactttaaatggagttgatattaggattacatgagcaaaggcattttaaaacccaagctcaaaataggcattccaataaatatttgctgtctgccctctcctttcttcctgtctcaggaaaagttgcacttccgtcagatggtacatatcactttttatgttagcccagaatactcgcaggaaagtaagcctccctcctaaagacagactgcatggagaatgagaacttgcaggactggtctgctatgcttttactttcctggtggctaaatctcagagaggattgcctgggggtagcggagctgagccccttgtgtggaggccacggtcccctcaccagcagagccaggcgatgggcaagcttccaaatttgcagtgtcgtctctgcttcttcctgactgagaattgggatgactttgggggccgagacgatgaggaaactttagctttacctctttttgtatcatgagataagcttgtgcggagctccacgtcgttctctcccttcctgggcaccccgcttgggctactttaccctgaagttacccgagaaactcagggaaccagttctcctttttggctccttgcttcgtggatttctcctcctaggctcagtgcacctgcagccacctctgtgcacaatgatgcctcccacgaaggaggctcaactcgcagggcacggggcagaggggagcagagcaccctcttagccactacagaccaccctcgcccagccccttctgacagcaaagggagtttggataaactgcacagataaccgttttgatttgcaggcaaagcttgggctgtatctgaagctttgccagaaattttcagaacctacacagaatgtgagctcctctccatgggcacgcctggctcctgggagcagtcctggccctggccgctgcagctgccccacctgctctccactgggtgccagatccacctctcaaatctgtgccacatggagcctctgctcagagtcctcagtggctctccacctgtcccggagtcatggcaaagttggtgctgcccacaaggccccacctcacccagtccttgctccctcaagggcctgatccacttctggcccccggctcattgcctgcccagctgcactggcctcctggtgggttctccctgcagccgagcccactgcctccctgggcctgcatggctgccttccttagcctgggtgcccccacacatttatagctcgaccctcgtcctcagcaaatctctgctggaggtgggggctaccctctcccgctgtgggagggagcaccccacactgagactccctgtccacaccctttctcctgagaggtaggtgttcatagtcacgtgacaccgcctgcctgagggtgggttgagaccccaccaccgcctggccccaacatagggcagcaaggggcgcctggagggacgtggagggaagccctaacagtggagtggggtgccctgtgtcacctggccagggctggcaggcctgctgggtgagagtgcctctgtctcctcacccaggcttcttggtccattccttcactcttcagatgtttatcaaccctagactgcgtgcccaatgccagggatgctgtggagtgcactgcccttaggcactcagaacccaaagacgtggagacaagacgagagagtctcccctgcccgtgtgtgcatgcgtgtgtccgtgtgcagtgggagctgccggcagtgagagggtgtgatctctgacatctcttccacctgtggccgcaggttcccctcagccctcagaccccctgaggggcccctgcctccctctggagttcagatacgtgaacacgatgggaacaccagaggaagcccctagatgctctggaaagtcagagccccccgaagtctcagtgacagcaggacaaagatgcagggccagcccgctaggtgggggagctgatggtggctaacagttccataagtgccccaccatagatggcagtcggctgtcagaggcacagttttgggttatttctgcaccaaaaggctgagggagtttctgaactattccctttttaattttcccttctccctgcgacacagagtgggttgggccctgtgtgtgtggctgacctgtgtgccgccaacggatactgcctgtgtcaggctgggtcactgcggtggagcaggcagcccatcaccctgcaggcccagaggctgaagggggcccggcagggtcaggggccttctctgggctccagcttgttattgcttctaggaaaccactcgactgcatgtgagccagaaaagtggcgcagcgttcatgtggcctccaggagagcagggctgtgggccactcatggccaggcagggactgcttctggcattttacatgtgattcttccacacagttgacttaggagagggaaatcttaggcactggatgtgggtttatccagagctgctgagggagctctccaaggttttcagtgatcgtggcatttcatgctgagctcccaaatgcctgatatgtgagctgcgatatttgccaagatgtgcctttgtagtggtgtcaaagggcagtgtgctccgccagccacctccagtggcatcctaaagggacagggaaggcgagcgtcggcaccctgccccgcagcctctgttcttcacaaaggcgcatctgtgtctgtggctttccttctccccaggtggaagtgaaaacacagactttggaagagctagtaaatgagtttaaaatgcactttaaagactccttgtagatggcaggtcctaccatgtcacctgaatcctttgtgaatgtagtatttacgaagcttaggaagaaaggtgatatagttttttagtaaccactttatgttcatagctcaggcttacacttaggaagaaaggtgatatagtttttagtaaccactttatgttcacagctcaggcttacaatcctttaggaccaccctgagaccacctgaatacaaaggagagccactgccatatggtaacggcatttggtgtattttcaaaacttggaaataccagggaatagggaaaacagcatatgaaagtctacgggcccacagtgagtaatgagcacttgacatgaaacctgtaaacgaaattgagctttgtatctgaaagagaaattatgttgtggaaacaagtttcattcataaaattcttgaatgctggcatattggcccaggaacttgtctgcttcatctgactcttggtgatgcctgtggtttctggtttggtttagttcactcatctacatcaagcaagggttggtggactaggactctctgaccaaatcctgcctgccaactgtttttgtaaataaagttttattggtacacagccataattcatgtatgcataactgctgtcatgctacaatggagggttgagtaattgacctacaactcctgaaatagtctctggctctttctagaaaacgttcctgacctgtgacatagagcacagcactatcagggccaagggcacaggtgttgtccctgtatgctcccttcagcgtggctttcctcttcggccattgggagcctctggtattgagtgtgcatctgttgggaaacagtgagtggagaccctggggacgccctcctctgtgaagcagcaacttaacacgcaggtccatgccatgcggatcagtcttgccgtcttcatatacaaagcccatttggtgttttgaggaggggtatttctccatatactaatgagtctgtgaagcagctatttcctccttccttgtccttctgaaagcaatggctccaggtttttgtaacatgaggacaaatcagagtcctgttgtgatctagccatgaaaagttgccattgtttccctggtcctgcattgggggtggagaatcattattgtttccagaacacaccagatttatgctggtagccctaacatgctacagtgaatgttttcattgcccagcactcaaacattcctctttggaggttgtaattattgtgggagtttgggttagaggcagagctggggaaaccttccttgacattcttagagttaattatggatttttaggtacagggagtggctgacttcctgcaccccagtattttcccagcccagcctctacaccaaaatgactgccaactaaataggaacattctagatcccaccgccctcctgaggtcccacacagccacagaaaccagaatttcccacattgatatttgagccagaagagatgcctgctgccaggtgccaccacactgcagctaggtctatgttggacttgcctctctagccagatggagccatggcagggtccactgctcattcactaatctcacagtagcacgacactcgacatgcttgggttttagatgccacatatggcagcctggtggggttttcatgtgctttctcaataccagatgctgaccttctctttaccacaggccccctcctcctccttgggaggggatagtttcttcctcagccaaaggcccatcccagggcttggcacttaggagatgcttgaatatattggtgacgtgatgaggagcaacctgaccctgctgaacactagtagtgatggccaactcctggcctgtgaagtacacccatctttggacagccctgcctcacagggagcctgcccacattgcagtaacatggggtccttggtgcaaatcccaccctcctgggtgactgaaaataagcctggttcttcagcatggtaatgatgtcaaagcttaaagacatgatcacggcccccacagcgctctcacttcccaggctgagccatcccacctccttccctggcttgccatgactcggttctggactgttccgtgatggtccacttctgcagcacagatgtcctgtagagacatgctagcactgaatgcaacattcaaggcatgctgctgcttgtccatactggatagactgttacctttttaaaatttttttttattatgttatatataatatatatttaatacttatacataacatatcagaaagttcactaatcataattatgcagcttgatgattatcacaaacaatatattcttgttttttgttttttggttttttttttgagacggagtcttactctgtcgcccaggctggagtgcagtggcacgatctcggcttgctgcaagctccgcctcccaggctcatgccattctcctgcctcagcctcccgagtagctgggactacaggcacccaccaccatgcccggataattttgtgtatttttagtagagacgaggtttcaccgtgttagccaggatggtctcgatctcctgacctcgtgatccacccacctcggcctcccaaagtgctgggattacaggcgtgagccaccgcacccggccaacagaatatattcttacctagtgatgaaatgatggatactggggctcctgtgcctctgacagttaccagcccgcccttcccgcatgtctactaacactacagatgagttgtgtttgctcttgaccttcacatcaaggaatcacgcaggatttatttttgtgtccaactttgttttctctcagttttatatttgtgagctatacccatgttgttgtagggcactgtagtttgctcattttcattgctctgtggtgctattttagatttttaaaaaataggtgttatatttttagagccgttgtaagttcacagcaaaattgagcagaagatacagagatttcccataaacctctgcccctacatgcaaagcctcctgcattgtcaacatcactcaccagagttagtgcatttgttacaatcaatgagcctatattgacaaatcgttattactctaagcctatagtcactcttggtgcagagtctactgatggagatgtcatgtatctaccattataggcccatacaaagtaggttcactgccctgaaaatcctctgacctgtctatccatccctccctcctccaccacccctggcaaccactgacctttgtactgtcttcatagtttttcctttcccagaacgtcatacggttgaaatcatacaatatgtagccttttcgtaatggttgccttcacttagcaatttgcatttaaggtccttccatgtcttttcatagcttaatagctcatttccttttttatcattgagtaatatgccattatctggatgtaccacagtttgtttatccattcacctactaaacgacatcttggttacttccatgtttgggtaattataaataaagccactctaaacatccatatgcaggtttttgtgtggacataagctttcagctcctttggataaatactaaggagtgtgattactagtttgcatggtaaaagcatgcctagttttgtaagaaatttccaaactgtgttccaaagttgctgggccattttgcatttctgccagccgtgaatgagcgttcctgttgctccacatcctcatcaacacactacacactacactgtcttctttggtgaagtgtcttctttggtgaaggtctttgactcaccattcaatcagactgttttcttgttgttgagttttaagagttttttgtgtattttgcataataatcctttatcatagttgtcttttgataatattttctcccagtctgtagcgtgtcttctcattaccttgacagtatcttttgcagagtacaaattactaattttaatgaagtctaacttatcaattctttcttttgtggatcatgcttttggtgctatatccaaaaagtcattgccaaacccaagatcatctagattttctcctacattatcttctaggagttttgtagttttatattttacatttaggtctgtgatctatattgagttcatttttgtgaggggtggaatgtttatttctagattttttgcatgtggatgtctagttttcctaccactgtttattttaaaaactatcttttctccattgtattgtctttgttcctttgtcaaagatcagctgactgtatttatgtgggtttatttctgggtgctctcttccattccattgatctagttgtctattgcattgccaatgacagactgtcttcattattgtaactttattttcagtctcgaagtcatgtagtgttggcccttgttcttctccttcaatatttgttggctcttctaggtctcttgcctctccatataaactttagaatcagttggtcaatattcacaaaagaacttgctgatactttgattgagattgtgttaaatctatacaacaagttgaaaagaactgacatcttgacaatattgagtcttcctatccatgaacatgaaatatctatttgtttagttctcctttgatttctttcatctgagatttttaattttccctatatacatcttgcacatattttgttacacttatacttaagtatttcatttgtacctaagtatttcatgataccatttacatttatacctaatgtaaattgtatcatgttttaacttaaatttcatttgtccattcctggtacaggttgagcatcactaatctggaaacttgaaatccagaatgctccaaaatccaaaattttttgagcaccaacatgatgctgcaagtggaatattccacacctgaccttatgtaatgggttgtagtcaaaatgaaggcacacaacacacagtttcttcagcatcctcaagggaaaaaagaccctcccaggccccttcagctgtgatatttattttccacacatgcccagattcccccatgcaagcacaaccataaagggtcataaaatggcacatgtgtaggctgcacatgccaatggcaggttctccacgtgaaaagagagatttctatgaccattgttgatgaggcagatgactgcagaaaaatatttttaaaagccatccagcagaatgtttcctcatccacagaggacccacttactggtcccttaaccacttctgatgtttccttgcaccaaaaaaaaaaaaaaaaaagtatacacttaccttttaatcaaagcacagcatcataggtagagactgaaagcctgccattgtttgttgttgctgttgtttaacagctgatacaggtattctggagaggctactgtgccgcttagttactctgaacatgtaatttttttcactgtattaataatatgtcatattttttactgctaaatacttatgtgtgaataattgtaagaaaatgattgcttattggtagcatataaatccagagtcagaagtgaggctgatgccaaacaaccacagatggtccgcatgggtgataccctttgctttttgtaggctcgatgtacacaaactttgtttcatgcacaaaattattaaaatgttgtataaaattaccttcaggttgtgtgtataaggtatatataaaacacaaatgaattttgtgtttagactggggtcccatacccaagatatctcattatgtatatgcaaatattccaaaatctgaaaacatctgaagtccaaaacacttttggtctcaagcatttcaaataaaagatactcagcctgtatataggaaagcaattgacttttgtatattagccttgtatcctgcaaccttgctataatcaagtattagttctagaagttcttcagttggttctttcagattttctaaatagatgatcatgtcatctgtaaacaaaggcagttttatttcttccctcccaatctgtacacttttaatttccttttcttgtcttattgtattatcaaatatttttagtatgatgttaaaaagcaggggcagagagtacattcttgccttgtccttgatcttagtgggaaagtttaaagtttcccaccattaagtttctcgtaattaggtgaactgtaggttatttgtagatgttctttatcaagttgaagaagttcccctctatttgtagtttactgagagtttttatcatgaatgggtattggattttgttaaaagctttttctgtatttactgatatgagcatgtgatttttcttctttagcctgtggatatgataggttacatttattgatttttagatgttgagccagccttgcatacctgggataaattccacttggctgtggtatataattctttttataccttgttggattaaattttctaatattttgttgaggatatttgcgtttatgttcatgagatatataggtctgtaattttcttgcaatggctttgtctgctttggtattagggtaacgttaacctcatagaagttaggaaatattctttctgcgaagtattgagattgtagagaattggtataatttcttcatttatatgtttggtagaattcactagtgaacctatctggtcctggttctttctgttttgaaagtttattagttgtttattcagtttctttttttaaaatggagtctcgctctgtcacccaggctggagtgcagtggcgcgatcttggctcattgcaacctccgcctccctggtccaagcaattctcctgcctcagcctcccaagtagctgggactacaggcatacgccaccatgcccggctaatttttttgtatttttagtagagatggggtttcaccatgttggtcaggctggtcttgaactcctgacttcaaataatctgcccacctcagcctcccaaagtgttattcagtttctttaatagataaaggcctattgaattatatatttcttcttgtatgagttttagcagattgtcttttaaggaattgttccatttcatctgggttatcaaatttgtggacatagcattattcataatattcttttatttttttaacatccatgggacatacagggatgccccctcttttattcctgatattagtactttgtgtcctctgtttttcttagtttgcttgctagaagcatatgatttttattgatctttttaaagattaatttattgatcttttttgtttcattgatttttctctattgttttcaatttcattgatttcttctatttcttttattttatttattatttgcatttaatttgctctttttttcctagtgtcctaaagtgaagatttagattatttattttagatcttccttcttttctaatcgatgcattcagtgctataaatttccctgtaggtgctacttttgcggcatctcacaaatgttggtaaattacatcttcatttttatttagttcaaaatattttttaaatttctcttgagagtttttctaagacccaagtgttacttggaagtatgttgttaaatctccaagtattttgggatttccagctatctttctattatggatgtctaatttaatgctattgtggcctgagagtagacattgtatgatttttatttgtttaaatttgttaaggtgtgttttgcagaccagaatatggtctgtcctggtgaatgttccctgtgggcttgaaaagaatgtgtaatctgctgttgttggttgagatattatgtggatgtcagttgtatccagtagattgatggtgccattaagtgctattaagttcagttatatccttactgattttctgcttgctgtctctgtccatttctgattcaggggtgttaaagtctccagctgtaatactggattcatctacttctccttctgtcagttttttgcatcatgtattttgacactgttgttaggtgcgtgtaatgataaggattattatgtcttcttggggaattgaccccttcgtcattatgtaatgcccctatttattctgataacttttctcactctgaagtctgttttgtctgaaattaatatggatatcttttgattagtgttagcatgttatctctttcttcattgatttgctgttaatctgcttgtgtgtgtatatttaaagtagatttcttgtaaacaacatatagttgtatcttgttttattttatcaacttaaaatttttaatttgtatatttacatcattaattttcaaagtgatgtgtgatagagtcaggttaaattctaccatatttgcattattttattatatttgttgcccttgttttttgttatttttcctgtctttcactctttttcggtcttttgtggtttttattgagcattttttattttctattttctctcctttattagcatatcagttgtacctctttttttacttttttaattggttgcattggagtctgcaatattcatttacaatgaattcaagcccactttcaaataactgtgctgctttgcaagcagtatgagtacttgtaataacaaaataatacttatttctccctcctgttccttgtatcattggtgtgattcatttctcttgtacatgagcattgtaagtgtatgtaaacacacacacataagcataaaatgatcaaatacattgtttttattttaaacagttatttgttaaatcaattaagaatagcaaaaataaaagttttaagtttactgccattccttctctggtgcgttgcctttctttctgtagatctgaatttctgacctatattatttttcttctctccaaagaactctttaaaaacagttcttgcaaggcacatctactggcaacacattcactcaattcttgtttgtttgacaaatctttattcatgcttcacttttgaaggataatttcacaggtacagaattctaggttggtaggttttttctgtcaacaccttaaatattttactccactctcttgcttgcattttcttttgaaaattcaaatgtaactcttttcctttgctcctttataggtaatgtgttttttcccctctgacttctttcaggattttttctttatcttttattttatgtagtttgaaagtgctataccaaggtgtcatttttctggcatctatcctgcttgttgttctctgagcttcctggatctgtggtttggtgtctgacaataatttggagaaattctcagttattattgtttcaaatattccttctgttcctttctatctttcttctccttctagtattcccattacatatgtataattgccccacaattcttgctttgaagttgtcctgcagttcttggatgctccattatggttttttttttttctaattttttttttctgtttgcttttccatggtggaggtttctattgagatatcctcaagctcagagagtctttcctcaactgtgtccagtctcctaataagcacgtcgaaggcattcttcatttctgctacagggtttttgattgctaacatttcttttctggctctttatctttgcttacatcacccatctgttcttacatgctgtctagttcaaacattaaagcccttagtatgtgaatcatagttgttttgtatccgtgatcttttaagtctaacattagttgccacatctcaatctggttctgatgcttgctctgtctcttcaaactgtggggttttttgcctttcagtatgtactgtgatattttcttgataccagacatggtggactgggtaaaaagaactgctgtaaataggcctttggtgctgtgggggccatgcggccacaaatgttctatagtcctgggatcaggtctcagtctttcagcaagcttgtgcccctggcctgtgaacttccccagtgcttctcagtttcccccactcctctgtaggtgaaacaggatggctacagtgggttgaagtttggtatttcccttgcccccagtaggtaaggctctcataaaaccccaatgggggccagatgtggtggctcacccctgtactctcagcactttgggaggccagtgcaggcagattacttgaggtcaggagttcgagaccagcctggccaacatggtgaaaccttgtctctactaaaaatgcaaaaattaactgggtgtagtggcacacgcttgtaatcccagctacttaggagactgaggcagaaggatcgtgagactctgtctcaaaaagaaacacagacacacacacacatataaaacaaacaaacaaacaaacaaacaaaacatcccaatgggtgaggctgtggttaactagtttatcctgtatgtggatcttattaagcacagaatgctctggcatgtttcacagtggttcctcttcccctccccctgccagaagcacgagtggatttttctctgatattcactatgaagacttagtggagctgctccttgaggcacaattcacaaaggtgtgggccccccagtgactgggcccctgcagttcttacctctcaggctgtccacactgaacctccagcacacatcagttacagttcaggccctcctagccgagcactgcttcccacggaggctgctgcttggggatttctggtatttccctattgatctcttcaatttggggggcagcagtttgccctgtgacctcagttctcttacagatctaagaagaggagttgctttttcagtttgttcagcttttttactcattgttaagatggagtggtgactttcagcttcttacgttctagactgggagccggacacccccctgttagctattgaatggtgtgtgtgctaatacacctttaacaaccaactcctaatgatagttactgtggcggttgtatttaactaaaagccacagacactgttttatttcattgatcttcttatcaaggaacatttatgttatttagtttttttgcctaaatggagaaatgtacaatttgcatgtatctgtggtcccggctgtcgactgtacttgtgaactatgatcctgccatcgcaggtatccatccctttcactgttaaattgcctggaaatcaactttctttacaaaagaaaagtatatttttgatatttggtttttcaacatttaaaaaaatttcagagtggaaatatacatgtcatttagaagcacaagaaaattacatgctgcttgctttcttcctgaatttgttttctggcatataagacaattctgttatgaaactattaaatacttggtattcactgagattatttgaaaaataggaaagaaaaaataaatataaaagtgttccacctcttctatctcctagagttatccattctttaaattttggcatatatattttcaaactttttctaggtatatatatatttaaactttcttaagcaaaaatagtaaaattaatgatgacattccactttatgggcaccatgcaaatgggtttgtatcttactttgcttttttcgtttaaaaataactatcaagtccactaagtaaattacagtaaattcatataatggaatgtctctgtgtagttagtgaggaagatctatatgtactgtcactaaatgatctttagactaaattaagtggaaaaaagcaagatacagaaaagtgtggtgagttcactaccatttatatctttctaaaaggcatgaatgtatgtgtgcatatatacgtttatgcacgtatacatatatacatacttgaggagaatatctctgtacttctctaaggctatataagaagctttatggctgggcatggtggttcatgcctgtaatcccagcactttaggaggctgaggtggaaggatcacttgagcccaggagtttgagaccagcctgggcagcatagtgagaccttgtctctacaaataataatcaacaaaattagctgcgtgtggtggcacacgcctgtggtcccagctactcaggaggctgaggagggaggaccacttgcgcctggaaagtcaaagctgcagtgagctgtgattgtgccactgcactccagcctgggcaacagagcaagacctcgtctcaaaaacaaataaataaataaacaaaaagaaacttattaatgattgctttgtggaaggtaagctgaaataccagcgatcaggactgggattcgttttttgaatttattttattttattttttgggacagagtctcattctcgcccaggctggagtggagtggcatgatcttggttcactgcaactttcacctcctggttcaagagattctcgtgcctcaccctccagagcagctaggattacaggcatatgccactgtgccctggtaattttttttttttttttttttttttagtagagacagggttttgccatgttggccagactggtctcgaactcctggcctcaagtgatctgcctacttcggcctaccaaagaactgggattacaggtgtgagccactgtgcccgtcttgttttctgaattttttactttttatttttatttttagatggagtcttgctcttgccacccaggctggagtgcagtggtacaatctcagcttactgcaacctctgcctcctgggttcaagcaattctcctgcctcagcctcacaagtagctgggactacaggcacacggcctcatgcctggctagttgttgtatttttaatagaaacggggtttcaccatgtcggccaggctagtcttgaactcctgacctcaggtgatccaccgacctcggcctcccaaagtgctgggattacaggcatgagccactgtgcctggcctgttttttgaatttaatattaacatttctcttttaatttccattatttctctcctgtatcatttttaatgactgagtgtattccattgaatgcacaatactgtaatttatttaaccagtccccttttgctttgcatttgtctctagtttttctctagtttaacaaacactgtaatgaatgtcttcagtaacaaatctttctgcacacttgatttttcttagaatagagttcctaggagtggctatttgtagctcagagggtgcacaggcttccaaggctttgatatttgataggaatcaccgaactgcctgccctacatttatatccccaccaaaaatgggaaagtgcctgttccatgcatactggccaccactgtgagttgggtttatgtttctcattgctaatttgacaggcaaaggaacaaaaggggaatcttcctgtttaaaactgtgtttgtttgaatattagccaggtatgccattttaaaatatgtttaatggaaatttgtttttcttctttcatgagttccctgatttttggccttggcctatttttctcttaaggtatttgtctgcctttccactgtttttttaagtctttatacagtaaagacattaagcctttgtctctcatgtatcctgcaagtatttttctgtttatttgcctttttgttttgtttctgttatttttaacattgagtatttagttttgctgtagccaaatctttgttatcataccttgaaatacattccccagttcaagattaaacatctattcatattttcttcttggacattcaagtttaatccttatggaatgaattttggcatatacagtggattagagaactaattttatttttttaatgattggccaattttagtaacattttctaactgattattgctggtatatgagaaagccaatgatttttatgtatttatcctaaaattggcaaccttcctcaaattcttattctaatattcacttgcttctaatttttctaggtagaaaattatatacctttctttctaatatttatacttcttgtcttatttttctatttatttggctctaatttctagaccaatgttagataccagtgtggatatcatggtattttctttaaaaaaaaaaaaaaagaaaaagaaaaagaaagaacgaaagaaacaaaattaatctggcattttcttctttttgtttttaatttttataaaattaaatttctatcttgtgatattttgctgttgtgacagctctgatgtgtgggaagcctttggttatctctccctttatgtgacagcgaagccttaggcccttaggctgatctgagctgggccaatcatgccttgggcctctgctggtggtgagcttgagaggcaagtcaggcacagatttccggagcattctgtgggcgcctcccccaagccagggccccactctagtgtcctcgtggtgtttagaaaagccctcccacacttggccgggcatggtggctcacgcctataatcccagcactttgggaggccgaggtgggcagatcacgaggtcaggggatcgagaccatcctggccaacatggtgaaaccccgtctcttcttaaaaaaaaaaaaaaaaattagccgggagtggtggtgagcacctgtagtcccagctactctagaggctgaggcagggggaatcacttgaacccaggaggtggaggttgcagtgagctgagattgggccattgcactccagtctggcgacagcacaagactccgtctaaaaaaagaaaaagaaaagaaagaaaagccccacacactcaacgctgagcgttgctggagggacgctctgctaaatgcccccagacctgaggctgacttttgggctgtgtgaagtgatatgatgctcttagaatgctctttacgtttttctggcctataatgtcagttggaaaaagtggcattgtaaagtcataaatctttttggtttgggtgtttttgaagctgggggttgggggagaggatggggaaagtgaggggtgtgattgcctctggtggcccccacgctctacttgttctcctgggagagggcggtttggaagaggcatgggaggagcttcccagcacagagcccagcctgccctccttctgtgtgatcccacatgggctgtccagctctgttagatcaatgctgcctcaactcggatggacaccaaaccctacggccccctccgctcccggtgaagcagtttctctgatgatttcttagaccccaccagcctaaaacatctctccctctgaccccaaaagaggcctgtaagtcccgaattgctgctttgtgttacagcatcagaggctccttggaaaggcgggtggtgcactcagctctgaggggcttctccatgaggccatctcttggccatctcctccttagcctgttcaagtcacacatgggccagctggtctagcagagaacaaataacgggggcagtttaggctgacaggccttggggcgttccatgatgcacctgactgccgaaggagggatggttccggagaagggaacagaggttcgccaaaggccccttggagtggcacccgtcttgcccaggccattgctgtggtggtctctgtctctgtctctgtctctgtctctgtctctgtctctctctctctttttcttttttttttttaatatggagtctcactctgtcaccctggctggagtgcagaggtacgatctcggctcactgcaacctctgcctcccgggttcaagcgattctcctgcctcagactcccaagtagctgggactacaggtgcctgccaccatgcccggcttatttttgtctttttagtagagactgagtttcaccatattggtcaggctggtctcaaactcctgatctcaggtgatcacccgcctcgacctcccaaagtgctgtgattacaggcatgagccaccgcgcccggccatctgtctctcttgacacttgttacagctgttttctccttcccccagggctcctctctggtcacgtcccactgtgagtccccatctctcctccgtccttttcctctttctcacccgccctgccattcgtctctgtgtctcttggtacctgtgacagtgtcctatttccttcctcgatgactgctcatctcccagtctcaacccccccgaaagcccgcctttcctccttgctgcctgcctcttcctttctccttccatctgtttccactttgtgcatttatacttggtattgtttaatattccaaagaattgaagagggttactgaaagctttatgtgcccatgactctaaataaatgtagttggactgagttatttttttgttcttggatgaagccagaatcttaaagccttttctacttagctgaatttatttttattccaaatatttttatttcattaaataaataataggagttgcattttaaagccctaactctgtggtacattgccaggctttcccatatggggctctttgcagctataatcaatagtgtcagagagggtgctggctgggttcggtggctcacacctgtaatcccagcactttaggaggccaaggcgggcagattgcctgagctcaggagttcaaaaccagcctgggcaacatggcaagacaccatctctaccaaaaaatacaaaaattagctgggtgtggtggcacacgcctgtaatcccagctacttggaaggctgaggcaggagaatcgcttgaaccccggaggcggaggctgcagtgagcggagattgcgccactgcactccagcctgggtggcagagcgagactccgcccctccctccaaacaaaaagaaagaaagagagggtgctcctgggtgaagatgtcagatacctgaatggataatgcactcttcttgaactcattccttggaatctcttccgagcctccacagtactaaccagtgtcttgcttcctttttcattgtgtgtgtgtccgtatgcttgtgtccacggtggacccggaactgcaggacgagattctgacggtgctcaggagagtggatgagaactgggcggaaggcatgctgggagacaagatcgggatcttcccgctcctgtacgtggaggtaagaccgtgccgccctcccacacttggctccttcttgcccacccttgtttcactacagtggggtcacctgaccttcaagccccttttctaagagagaaagaggatcctccacaatagcctctggccagagagctgctatgtgtgggctttgattcacctcatggggtcagtgctgtgagcactgccttggccagttttgagtggctggtcccaggcctggctgcaagtcatctcaccacgtgggcagtggcagcagggcccccttgtgcaccttccccgttttctcaagggacccctgcgcctggcacccatgcttctccaactcccccaagtgctgctgctcttttctcatgagcaccagaggggaagaacccgtcccaaggcagcattttcccttcccactgcacacggattggaaggaaccgttgctggccatctgcaaagtcctccttggactcagggttattgggcaactcttctgcctgagaggcaccacagcaaaggtgttttgaggctaattccagacctactaatttcctttcccttttctgtaactaaagcaccaggtttctagtgagtacgtttagggtagctgctgtgcagaaagcatcttaacacgtgtgtctttaaaacacctgctagcctggggctgtgtgtgtatgtaggagtatttgcctatggcgtgtgtgtctgccatttgtcagtgcaaggccacatgtgcacattggtgagctgaccacatgctttcatgctgtaaccaccagcgtcatcccataagagtggcttcagtgaatgcttactgagtgcttgttgtgtgccagacacttggaagtacctgctcatttaatcttctcagcaacactggcatatgaaaaccatgaatggccctgctttacagatgagcaaacagaggtgcagaaaggtaacgtagcattctcaaggtcccacagccgaggagtggcagaaccaaggtttcagcgcgggcctcttggccctagactcagccagcccttcactctcctgctctcacaccatatcctgcctctccactgtctctggctaatgaactgcagtttactcagctcagtgctgggctccatgtgtcccccctgcctgacacacttaagggcttcagagttggcaccgaaagcccacgggtgacacggccagctttgccacacctaccacacagtgtgcagatacttaaagatgtttgtttaaaacatctgtcaattccccgttgcctgcaggataaagtccaaatgctttagcttagcattcaaagccctttgcagttagtccatagtctattttgcagcctcatctctcatttcctcccctcttcctcaaatattcgggaccagtggttctcgcacatttagtttgaatgtgctgcccaggccatctgaggccctcccacagcaatggcagataattcacacacacacactctcctgtaagattcacatctgccctcaacacttcgcaagtttccatgtatttgcacatttgctttagcttttctgtcctggtgcttaagaccaaagaacttaatgcgcgaataccacttacaatgtcgtccagaagtcagaaatctgagctctcggacatttttagctggccaaacttttttctccaggcagaatcttactgggatacccaacatatacatgaatgttcatggaaagttcattacaatggccctaaacagcataccactcaagtgtccatcaacagtgggatggctgaggaaaatgcagtatatccatacaatggaacgctctcccaccatgcatgtgaacaaaagagtaatggctttaagggcataggcaaatctccaagtgaaatttttgaaagaagccagacataaaagtaaatgccgtatgggtttttttaggaggttcaaaagcagacagaactcctctgttgtgacagaagtcagagcagtagtgaccttggggattctgactggaagaggtaaggaggttctgggctgcagaaaggtttcgtgtcctgatctcgggagagctgcacagattatgctgctgtaaaatggtgtccagttaagctttacacacttctaactgcaatttcaaaagctaagagcaaatcttaaaggacaggtaagatcttaccaaggcagctgacagtagcggaggtggctgaaggctgcgttgggcccctcagcccctcctctggaagaagctgtcaggcaccattgggagtccgcaagcaggtgcaggcccgagacccagtccagcaggctctctgtcatctcttcctggttccacaggcacactcagagacaaactggggagtcagccgcatctgtgccttcctgcagcatgactgcctgtgggtctgaaaagccaccttaaagccctcctccctcagggccatgaggagggctccatagccccacctgcccccacaccccctcacaggttctgcctccactcttgggcacagtcccttccacccacctggataggaagccctggactgtccttcaggctcagagacacagacctcctcccaagcatccttgggcagggggccccactgcccctcttgcccctttctgagatggctgcccatgcagtactgggctccacgccacacacccatagcctggcagcctcagctctgatacaggctcccggactctcagcagccactgaagaccagcctgaacaggtgtttcctgggacttttcattctttatgtactgactgcttgcacgccacacaccacatggatcctggtggatcggaaagtcctggtttggcccaaactgcttccctctgggaggccgcacaggcatttgaggtgggaacttgggtgtttgcagggttcctgagagagtcagacccacctgccaggagggagcctggagcttccatcttgggctactgcacaggcagccggcacagtcccggtgatgcttgtcccctggtgcaagaaggaatgtagcagacccgtcacctcacactaagaggatatcttctttcatgctcacgtaagcttggattgcatgaaggtctcctccacagccgctccagccgggatctgcaggcacctggcagggttctacccagcgcacagctgccctatggggttcaccgagggactctcacctcgcctggcctcacctggcctcagcttcccatcagcgcagctcaggccatgatgctaagcccacggtggacctcacaaagtaaacgagagtgtgccctgcacagtgctctccctccgtggttgtgtctccaccagggcctgccagtggcacagtgagctgaagggcacacacctggcctggagccagcctggccttgcactgcttcagctgctttcagaggaggtggaccccgccctggacatacgtacatttccctctgctgttctatagaaataatcgtctctccacagcccctggcacccacctgccacaggcattcacccatgagctgggcttgctgcccctgggcactgaccccatctgtgctgtgctcaccggagatacctcactccctgcccagctcttcttcccatggctccagccaccgtcccatgccctggaacctgcctccttgtccttttcgcccatcgttttgcaaaaggaagtgagaaactctcctgcggccgtccccacgccaggacccagggcacgtctccctgacacctgttcatcagatgccagctggacagcgccccttgccaggagcctaggctgaccctgccccagtgtccactcgggcacagagaggagtgggcctggcctctcaccctctggaactctagtctagcggatgggacaagaactaaatccaaacactccaccgggccttccttctgggtctttagcccttgaggtttttcagaatttcagaaggcgcttgttctaaggggagtgaggatgagccagtctgaggaattcctcctccccagtgggccagggcagagtgaactcacaggaggatggcaggcgagggactccgtcatccagagttctgccctctctgtggcatgagtgccggggctgagcacccctgcagcccccctctctttctgcacagggtccaagttgacctgcttggggtcaggcctcggcccagccctcagctgttgagaacagggcccattcctcataggccctgatggcaggaccatgagcagcccatgggcagttcagggcgatgcgggcttcagagcagacctggctgggcccagcttgtcctacatcacctgcacattgggggcatggcctgtggtcaccccctttaccttcctgagcctcagtttcccccttcaaacaagggcagtggcagacgtcatgggctagccatggggcatagagaagataagaacacacaggctgggctggctggggtaggcagagagcactgtcctgtgctggtggtggtggtgtaaatgtttgtggagtgaaagctgctcctcggtccattgctgtgttgattgaagatcactgtgtcattcctgagcactgaacacatttggcctggttagctgaatgggtttgaaggcagggcagtttcctgcctgggtgaggtttgcagttggatgatgtcaacaataccaggacacaggtccagggtgtggacgcttaggagaggcagccctcttggaagctgtctttaaggagcattgtcaggaaaggaatcagctcgggttggagagacttgggggcgggacacaggctgcctctggctgctcacacagagcctgggtgggtggcttgcatggagacttagaaggcatgttagcaaatacgccagtgattctcgtctgcgaggaaaacctctccatggggccaggatcgtgatccaaaaatagttcaaaaaaatgatgaaagacagtagacacaagtgtcaagctctgcctccacattgacaacatcggttgtccaggtagagtaatggggagacccagatctcaaggaaccaactgaaaaagaccccccagagatagtgctttacttatcctcaataggatattcagaaattggctgctccctgtgttgctggtgtgtgcgtgagtggtcacctaggtagaccctcatgccctcaccccacacgtgcatgtggtggcatcccaaggatccttagagacagccagcatctcagcatctctgacagtaaagggcggggaggaagaaccccttcctttgttcccctaagtttccatggtgaacagtgaccatcctgtgcctagatagaccctagtctgcaatgtgaggacagacagagatggggtgcggagcacctgtcccggcagccagcacataccccagacaggtctgcttaggaaggaacagagagccgctcagagtccgggctattttgctgcctttggatttggcttgggctgaaaaaataggtgcctttccctggggggaggtctagaattcaatcagagctgtaactgtttattcttggcgtttcccattgattgtctgtttctaattgagcagcttttcaggggcatgtgatgggtgcacactcctctccacttggctaataagaagtgtgaagcctgagggtgctggacctccgtgggccagcggggcgttggtctgtgtggggagatgctggagcacgtggtgagcaatgggtcacagatgagaggtggaggtggggcccagctgctgatgatgagcctcctagtcatcccagtgtctgctaacccagaaaaaggccatagcgtcagtggctgtggtaggataaccctaggatccggggaagaagcagagctggagggggcagaagattcagactctgtgacgccagacccaagcctctgtctgctgtcaggatgcttgtgccttagttggttgttgaattaatatggtgtggtgtttgggaaaattgtggatggaatgctgtttatagatcctggaaaaaataatggcagccaacatgaaaatctttatttagtgaaataatataatacccagaaaaatagcaggagttcctgctgatggccatttcccgtttgagagtgcttatcttcagcacaatgatgatagcgtgcctcatcagaccactgggttctaagccttggttgatgcagcaacatcaagctcagttcctcctgctcctgtagcaccggtgcctccttgtcactttatcttttacaaagagaggctattattttgaacctctgcctcttaagtatgctcttgagacgtttggtggtgacttaaaggcacaacgacagctctcattgggagcggatagctcgggcattgttgttaattgtgcacactccgcgttctgcactacctcaaagtagtgagcagctccgccgtgttggatttgccattttaccttggtcttgtgggttttcggcccttgcctgggccaggcgggatgtgttcagggaggaagaggggaagggtgtgacttcccatgagagccacaagggaagtatcccaggtgctgaactgaggctcctctctcctccgcagcacctccagacctgtctgatcctgtggtccgggtgggttcacccaccggcttgcactctgggtcagggagctggctcatattcacagtcctggtctctgccttccctcctccttccaaagaccccctcagcttctctaagagaaacccagcatgccaagaaccacataggcagtgggagagggatggaaggatgggggctctagttctcaactcccagttgactttatgcacccccacctgagacggggttggaacacctccgactcttaatcttgcctatgaactagaggctgcatgggcttatggagctgtgtgatgcttctgaggcaccctcctttttctttgcatgcctggtaattttcagctggttactgactttgtgaattttactgtttgaggtattggacatcttggcattcctgcagatgttcttgagctttgatttttgttaaattgcttagactcagtttggtgtttttgaggctcgctttgaggctttgttaggcagggccagggaagcctttcatgtggggctaatttctctactgctgaggctataaccttctctactccatgccccatgacttatgaggcttccactctggaagttggaaatgaaaactattcctggctttatgtgacctcagagattgctctgccttctccttgtgggcagttctttccccagtgctggatagttccctcatatgaatgccctgatcagctctcagctgaagactccaggggactttctgcagatctccaggactgtctctctctacagctccctcctctccagaactctggcctgcatcctgtagccactgtggctccccagatccagaactctgtcttctcaatgcagggagaggctagagaacccagagacagtaacagagcccatgttatgggctccgccgctcttggtgattgctgtcctgtgcgttctgctgtcccatatctgcaaatcttgtttcacagatttgttttcagtgtctggagcaggagggtaaaaatgttacccatcatttcaccttggctaagcagatgttagccagtgatgctttaggaattttgaaataagggtcagaggttccccagggctcaatctctccagcttcagtgccaaagtaataatccaggacttttccttagatgaggaactggaaaacgcctttaaagtcatggtttaccatggagatgggttacaaccaaacgccaaagcccgtcccgtggtcccactctccaggcgagcccctcgcatgtttgtttcactgctggtgttccctacacttctgctgacagatgtggccgctgcttctaagagtcaggacaccctgatgatgccacatcagaagggatgtgaaagtatgaaggaaaaatactcagggatgtctgccagggaacgctggggaagatgcagttttgtttgaagtttcattttatttttcttgcttttcgtcatcctctgtttttacaagctcctgccgcagcgacagcctgtggaagggatcccccagccttagtgtggatgccaatcctgcttgcatttctgtgtcagtgtggactgtgcctccaggaacactttgtaaagccctcctgcaggtgaagcccggtcattgccaagaacactgggcaggaaagccagaagcgaggaccagaaggcagggaccaggaagcacccaatggcgtgtctcctggagtgtgatgttgtgtctatgtctgaacagagtggtccaggaggcaaattcttagacctatcagggagaataagcagtggtcttgccttcaccagtaacccactgtttcccttacctttcaattggattaacgacataaagaaataaatgagtgtaaagaaatgagacaagactacataagagggagactccagtcgcattcatggttggggtctgtacattttcttgccgggatctgactgccaaggcgtgatccacacatacatgggtgttcattgtagtttgggtttgtttgtctccagcaaaaataggtaggtgcctaggtaccggctcgccctgatttctctcttcttaagtctttttgaggtcttcgtgaaattaacatcttataatagaatatcttacattccattgctgctgggagtcttgttgctgtgattgttttgtctccctaagcccctttgaggccagacctgtaactcacagttgcttcccttctgggtcctggcacagggtggggcccaggtgctagctaccctgtgcacctgtgcaatgttattgggttgtggttcagtgttttacagagctcatcaagcatggggaatgccccactgaccatctctaaatgggtctaagctgggaagcttgcagcagttcttgtatatctgtggcaagacagcttagtaagtttttgtgaagccccttgtcctcgctgccagcctccctgggagcttctgtggggacagtgagtagccctgaccgcagcctgagtggctcagtcatcactggggccacagcccaccttaaatgttgtcagggcctggcgaaggggcacatggagccttgtgccatagttcctgaggtttgatctcaccctgcccaccttagccaggcaatccctgcccaccaggtgccccccaccacctgcataggcagacatcaaactttttagattcctcccaagacctcgatgctggagagccagacactaattcagggcctttggaggccccagcagggcacgcactggtcctcagcaccagtgcactcagccttgccagaaagaagctgcatgcatgtagaccagcaggagtcgttgctgattgccgactgttttggtaactaaaatggactacctgtgttggctttaagcagtagttgtgaaattgtgtgtcaggaagagggcttcctccacgggtctaccaagtggtctaccacttgctgagtgcagagccttgtcctggtctggatgcgacgatggaaggcttaagtgagtcatctcctgaagagactactcaggactggaagtgtgtcagcctaggggcagctgaacacccaggtggccctggagcaggctgctggagcgtctggcctgcagccggtggaagtaactgagctccaatcttgtgtccagactgcttctcccctaggctccagctgtttttctgcttctcctgtcactcatatggacagtgcactttccactgagcaggtcaatggcggggttacttttacacctaactttagctcctctctgggccctgctggtctcagcacgcacacccacccaatcctacggagacagagttctcacacctaccctccgcagggcatcttgggccatccacgtccacctgccctcccttcagcgtggccatcacggtgccctgactcagcttccagtcccccgggcttccatgttcttgtcttccctttcacttctacctttcctgcttgagtaagttaggctgtggctcgcaaacttcagtgagcatttgagtgttgtcagaaggcccccaggatggctaaatagtagaaaggacagctttactggtgacatcagtttgcaagccaggaatagatagtctctgacatggaacgaaggtgctctcgcttcgcagaaggggaagggcagttggattttatggctcgcagggtctgtgttacatagtagaatcagacatgtttagcaggtttgggggaaagctgtgcatgtttataaggggagctgagtgcatgtgcaatgggcaaacatgtacgtaacacacatctcatgtcactttagggtggggtttcagcattaaaatgaggtggaatttggctctttccatcaacaggtgaactataggacacaaagacagcctgtgcacagcctccataagttgctgaaactggcttgaggtctgcagttgcttatgagaaaggggtgtttgtaagggctgtcctctgtcccatcagagttgcagtggtctgggttataaatcagaggggtctgatagcacctattgttagggagtttagcaagagtgtggctttctttgtagcccaggaatttaggaagttaccatgccagcacataggtaactttgtttccttaaccatagggtctgtcttagttgctgaagggacatctgttttggtctcagataacacaagtcattgggaaagctgcaggcccagcccaggggagagtctgctgcagtggggctgactcagcctggggctgaggctgcctgcaccaggcccacctgcgcccagcccactggccacccacctccctcagcagcccacctcctgacccccgacgtggttggcctttcctcagtcctcatctgcatgaactctccacacttagcacatgcccttccgtcttgcagctgtgtccccaggcctcagcaatcttaaaacagcccctctgtcaccccacacagagcaccccagtcgtctccaggaccttcctttggaacaccgagccctgtcacatcttcaaatccttctggtgcattctaacatccgtctgccactgaatcttcagaacagccttaggggaagaggaaggctccattctcctggcgagagatgcagccaagccccatccagggcccgcagctgatgagcagttccatgccagaatttgaagttagcacccccaatgttctctgctttcaggattcctagtgcagagacatttggctgttggattatgaaccctgccccaatctgacctgcagcttctcctcccaccatctcattctatggattaatgtgtggaccacgctcttccaggcccatgctcacttctttcctgagtgttccaatcacaacactcaggacttgagagtgtgtctgaacctggagatcggccttaggaagtaccatccacatttaaagaagtttggaggaaaccggtgtcagattccatgcagccctgagggcgggccctggctccgaggcacttgtccccaggcagaccttgtgagtgcttgcagcttttcaggcatggaagtgaaagcatacttagctgtggagagatttggcactgggtgcctgtaggatgacagcagcacttcttggctgaggtccagggctatgtttggtacagaagaaaccatgtctgatttttcagctggaaccaagcacacccatgtggagtcactggggggtcatgggggaccccaaacatctttattccagagcagcccatctttgcagggagatctatcctacaggtctcggttgctgttgctgcctcacccttagttctaagacttggcaatggattatgaccaaggttgacactctgggccagttggaatcattcttctcttgtcttcatgcttctcctccatggtaccttctgttaatactttctgtttccaatggatagggtgcaggcttctgcgggctgaggcacgtttaagattcgggtccgggaaatgcccaaaccgtgtgtgtgccctgtggggtactttctgtaaccacctgaattccacctgtgatgcagaatgagaaacagcactgattccagcttcatttcgttgctgctcaacccccgcagaggagctcagagctactctctgttgcttttataaacgcctcccaaatccttgaaagtgagagcaattaagagtcttagtttgaagctcttgggacatcagccgcattttccagacgtcctgttttcagtgatcagtccgtccttataccctttaagtaatttctcatccctcagccccttccaccctaccaccccgctgagtctccagtgtctgttaggtagaaggttctgatgacagtctagaggcttcctggctgccacaaacagttccttcagggctggcccctcacaaatgaaggcagcccatcctttccatctctgcttccatcagaggaccacttgctcctcccacccttaggtttctgttggtggcttagcctttggtggagagagcacatcccactgctgggcagggcagtgccctccccacagttccttccaggccgcctggggtcccacgttcatccagtccttaagcgccggctgcgggccaggccccggggatgcagcctgaatgaagcagaggagaaccctggagaccacatctgccagggaggacacaacagcgaagaaaagcaagtctggaggggattctactctccgtggagaaagtaacaccaggagaggaggaaggacctgggaggagggaactgcagttttcctgtcagcgctcgggacttggcagggaaagcggccttcggggaggggcagggagggagcaggtccaggggtggcctgagctggccgagggactctaagccagggtgaccaagcaggcaggtgggaggagaggggttggggtcagaggggcagtgggaaaagggcttcaggggttcccgcaggtcactctgaggacattggcatctgctctgcatttgggtctggggtctctcttccaggccccttctctgccgagtgcccgcgaccttgtgcctgtgtccatagactcctcctgaccacgtccttgtcattcctaagcccacccccgctttgctgaggtgaactttgatagtgtaaaatgcatgtggagggagccttctagactaaaagtttcgagctctggtcatagggaacccacagggtcttgggcccctggggatgtgggcagaaggcctcagggtaactccaacccgatggttcccatgtggcttctgagggtcccacttcccccacagttcattctcacacagccatggaaccaggaaccatttacttcactattgcttaaagccaccagtggggcccattgctcttagaataaatctagactcctcactgcagtctaccctgtgggtccacccagcctcacaccctccctgcatgcctggccctgatcgttgtcccggcatgctggccttcctctgtcccttcatctgtcccttcctctgtccctctgacaggccagacccctgcccacgttggcatcagacagtcgagcagaagctctggctctctctgtcactccctgtgcctcagtttcctcatctgtgtaatgggagtaataaccttacccacctccaagggttcttaggaggattaaattggagacatagtgaagtgcacaaaacagcgcacaaagggagaagtatgtgttagaaatgattgttaacttaattgtagtttgggggccctgcacaaccccagtgtcccctgagtcacctcccatgtcactctgcagagagcaggaagaagcccccatgtcctgttgcaaaaatgcattttagtagcagcgtgttgtttttgatgctgcaatatgaatatccagtcctcttgaaaatacaatttggaatagtcttaggtttcattcgatgtgaaggaaacaatcacttagagaatgagtttccttgaactgtccagggcaaaggagcctgtttgaaataatcagcgcttttgggaaagggacaaccagtgtattgcaggcagagcctgaggtcagctgcttgagcatcagaggcagggagcaccccacacaagctctcagacctcaaggggttggccaagcctaagcctttgtgtcccagccagccctgccagggtggactgtgttatggctgcagacttatcctgcagccactggactgaggtaggacctggcaccagaaacaaaaaaaataaacccaggaggtcaaatttacacgtccataaagccttttgtatttaaaaagagatggacgtttggttgaaactctgctcttcttcatatttcttattggtaaatttgcaacacagtgcatctgttcacctgtttttaaatatgtccctttgggttaagttggggttttagttgtagcaattcttcataccctgttcttggatccagctgagggatgagctggaatggaagtgctagctttaggattgaaaaatctcaaaagaatgtagattggatctggaagctaaggaacgtgcatagaccttgaaagagagggtcaaggctgcaaagctgaccgccttgcctggaattgctcctttcaacagagctggggagggaaggaggaagtgacccaggcttccggccttctccccagtccctgaggatggcctagcccctgtggatctccctatccgttagagacgcatatggagcatgtacaggtgacattgtgtggcttctgcaatttgctggaagcagcagggaaggtcaggccgtacatgaagccaaaaggaccaaacaccagggggccgctatgactgttacaagaagtttaaaaaaaaaaaaaaaaacactgtggctgcttgtgtggcaagtgcagttataaacaatagctcagcaggcgggctgtccctcaaacaactttatttacaaaaaccagcgttagctggatcttgggccttggtttgcggcccttgagtgtgagtcctctacccacctctctgtgtttctgcttcccttctgtttgggcccggctaatccctaccactttctgagctcttagagcttatcctaggggcagccccaggatcctggcatctccctcaggtgtcagtccaggtctgtgtccccctcagctggtggctgtcacctagggctggaaacaaaactgcccaaggaagaggaaacctttgctagaccttgcctgaaacatcatgctcttaaaaaatgactgcattctcacaaaaccaaagacaccaaaggctctttagggcacctcacgctttgtacaaaatcaaaaaaaatctgtcactgccgcagctcaggaggtctccccataggtcgatggagactccagcctaatctgcttttttgtttctaatgactttttctgattataaaaataatacctggctattgctcaaaataagaaaattcagaaaagtgtaaagaagaaaattaaaatcacccataatcctaccagtaaatatgaatatatgtgtagagaaagaacgaggtgaaacgttgttagcatattgttctgtttcttttattcttttctatgtataaatttacatatattttggacaaatttgagattgcgctgtatcagtatttctgcctggcttttctcattaaattgtgagaatattctcataacatgattgcagtagcttccaagtgcctcacctgtgcaaccttttctcagcgccagggccgggggatcctgttgtgtccctgtgctgctgtagagccctccggttccccatctcaggggagatccaggacctcccaggggcccagaagcttcagcactagttgaccccatcacccccaccttatttctgcccatgtgtctgctccagccactctggccttcttgcttttcctcagacactccagccagctgctgccacagggcctttgcacatgctgttcccacctgcccatcacccttccccagatgtgatggggccagctccctcccacatctcctcaaggtcttggctcacaggtcagtttccctgtgaagcccatctgggccccctatttaacctgcagcccctcagcatatcctcctctcatactttttcctccatgtacttctcaccattcaacgtcctctatgtaatgaaatattcacttattccttgtctgggtatctgggagagcaggggttttgtctgtatttatttcacagtgctaagcagagcccctggcctgcagtaggtgcccaattccaccttcttcttccaaagcaacagccccagatggttggggggggggtctcctcccccggcccatccacccgcacacggcccttcctgactcgttccactgctcccacactggcccagattcccaaccatgctgaggctccccacaccaattccagggactcctcggtccctgttcaggagtcgacagaagctttgtgtccatcctgactcctgttcagccctcacagcctgaactcctttagacaactcttgacccctgtgcacacacatgcacacacattcaccatcctacgcctgcccacgcctctccatgaccttgaaatacttaggtcacttatgtccttttggttgaaatactttgtcactttctatggttatgtcctgtctgtaaccatagtaactgagttgtcttcccctctcagccaagcctttctctagtagcactttcattcaatttttcactgatgagttagttgcagcatgcctgttcttaagctcctttgtgaacatggaacacatcctaaagaaaagttcttgctgtgaaaaagctccacctgccacagattgcctggcagagctcacaaccagcagcaggtactcagtgagtgctgagtgaggcttggactcatgcaagatccaccaccctccccagccaggccccccaggtactctcagctgctgaccctgtgtctgaagtgtgatgtgagttacagctctgtagaggggtgagaagtgctgagcagtgtttagaatatactcaacaaacagccactgctgcatgcacatgcaaatgctagctgcattcattcaaacacctatgcatggaataggtgtttatcgagcatgtactttgcccccagcactaaacatttgaagcatctgtgaaatgagacccctgcaagaggatgaagtaggctctaatcctcagacctccaaggatcagctgtgacatcttgatctgatcactttggctttgttctcctagggttgctctgggatgtcagagagagactagagagaagggggtatagagacgggagggaaggaggaaatgcttgccacctggaggctttctaggtaatagagattagtggtgaggaggtagcaggtgagaacatgagggctgcagtgtgcagccaccacgatagtctggctgatgtcctgtaaaccacagcccaatgcaccatccctccagctacaccaggagcccatcacatgcagcatcataggcccaaggccacacaagccagggtaagttcaggtgccactcaccaaccttgggagctggttttctgtcccagagaagctgcacatagaacacaggtgagcgtacctgcagacacacagacatccagtcccagccccaggtgcctgtgggttttgagtcagctgtgagggcccctcctggtcctcagcaagaggggcaagcgtgggccaggccccgctccttgtgcatcaggttcacaccctgtgcaaacaggaggaagagggccttttatttctactggaggcaatgtctgtcatctcccctgggtgccgacagctttctgtctttgtgggtgtgacccacagtgacactgcatttgacatcttgaccgagggcataccgcatgagtgtgtgagcctagagaaatggtctgtgaagctacttccataccacatggacgcatgccaatatttattctattccgtttcttaaaaaggccggtcaggacccaatcaatggatcgtttgaaaaccactgctctaagccagagatctccaaggtagggtgcatgccactctgtgcaaagaagacatgagaaattctactcaaacttactgaaattttaacttgttagttttaatttctattttgtgtatggctattttatatatttttggtaatcaaatatattatttggtccactagataaatacaccaaaagatacacattacatatgtataatgcgagtgatcattggtacatcagaatataaatgcagaaatgcttccctgatgggggtgcactgtcagagaacaggtcagagcccacctgcctgggctgtggctgggccggccctgggagctctttgggtggagcggccatctgccttctcctgaatctgtgccagccactcctcttgctccccttgttcctcctcacccacctaagatctgcgatttctaaggcagaagcgccctgggaaattaatcactttggtcctcaggttaaaaatggccagaaatccacgtgcagcacacaccccaccggagggactcgcccaggatttaagtgtctaccggaggccatgcgggtccccacctgctgccaagggtctgaggtctcttcactgtcccaacagagagacttcccttgtggcagttcttggagaaagtggagaataagtgatgcccttcacacacttctttgcccataaactaccagtttatctccttttaggttcatcttcaggtaaaattatcacagggtccttatcccagtctgaaaacttctaatcagcggtccttctgctcacaggacacccctgctgaggggctaatcaggccgttctgctgctcctggtacttttatggacttggacacattcctagcaaatgagtgaaattttctgttttcttatttagtcctggaatcttccttctggcaggtcttaatactgaaatgacaatgtagattgccagtccaggagggacacatcacccaatatcaagaggttaaactcgaagcaggtggagcctcatttccccgtgaggactagggtgggatccagggaggaagaagggtgacataactatgacaaaggtgcaagtgggggtgcggtcggcatttctggttctgctggcgagacccatggactctgggatgaggaaggaggcattgacagccgcagggcagctggaggttctttggcagatcttggttttgagggctggcttgtggggcctcacaggggcggtcgcttcccgggctacccactatgagatgagcctggcccagggtgtgcagattcatgtgccacatcatagggcactggcagagggcggcccctgaattctctagagggtcccggcatgaatgctgctgtgggctgtgtgacagctggggtaggcgggcaggttccacaaactgatctgcagcttggccaactgcccccaagcagctagcacccagaggcggacaaggtggacgggtgccacctgcctctcatgggaccagcctgcacctgacagggacagggttttgtccagtccataagagggggctgaaatgaaaaccattcgctccgactccctcctcagatttttaaatgtcaactcttccaaaagccttgcctgtactcaggctttacgtgcaaaattaggcagccatttgtgcagtgcaggtctgcacctgcgttttaaacttcagttatccgaatagtcacctcagcttgccagcccattgggcagcccgacagcagcctgacctgtatgcttcagccattacaggacggggaccagggctagaatgcaaacaccaagaggacaggatgggaaaggcacatctgccatgtgctggagggatgcaggtcacccacaggctcggggaggggtgcgggtcacccatgggctcgggccttcactctggcagggccggcggcctcacacaggtctccagcacactcctgcagtgctctagtgttgctcagcctctgtcaaactaacttcaaggggggaatctcctccagggtagaagcctctcccatagcaggtgtgtggccacggcttgtggccgggcagggagcatcagtccagagtgctggcaccagtgttttacagatgcctagggttcgatgtccccaggaaataagagtttggcattgtccacaggcctctgaggccactacttctgtgaataaagggaagggaacagaacggccaccaacccttggtaactatagctggcatctgtcccatatgagaatttgcctgacccacttttcatgtcattttcaacctcctaaaaatatggtcttcttttttttttaattaagacagggtcttactctgtcacccaggctgaagtgcagtggcgtgacctctcaggctcaagcgatcctcccacctcagcctcctgagtagccaggaccacaggtgcatgccaccacgcccagctaattttaattttttacagagactgggtctcactatattacccaggctgatctcgaactcctggactcaagcagtcagcctgcctcggcctcccaaagtgttgagtttacaaacatgagccactgtgcctagcccaaaaaggcctgatttttaaagacccacatttgaatctctaaaatgtacccaacccattccaatagtcaagggcataggtatacctcagtgaatatattcttttttttacatcaagatgtagcaagaggggaagggcctcctcgtactctgcagtgacgaggggatggcagcagattcaatgagacatctcagaaaaggggtgagcagtagcaatggtgctgcttgttcactgtgtaacttggaacaggtcacttaacctctctgagcctcagtttccttatctgtaaaatggccacattgctgtcacctcgtggtggatataagggtctgatgggcacatgtggggatgaaggtaaagtcggcttggccaggggtggtcaccaggccccttgcttcttctttttttttttggagacggagtctcgcactgttgcccaggctgagtgcagtggcgtgatcttggctcactgcaagctcaagctccgcctcgtgggttcacgccagccgttctcctgcctcagcctccggagtagctgggactacaggcgcctgccaccacgcccggctaattttttttttcagtagagatggggtttcaccgtgttagccaggatggtcttgatctcctgaccttgtgatccgcccacctcagcctcccaaagtgctgagattacaggcgtcagccaccacgcacggccccctggcttcttactagcttagtcactggcaaagagtccctggctttggaagcctttctccttaaaggctcttggaatgttccacacacaactcttcaggatgaggggtgcctatgaggagggcgaaggaaccagtgtcaaagggaatccttccctctccaccgcccctgcttagtctcctgaagaatgacgtgttttacaactggcaagtgttgatcgaagtccagcccagcccagccatcttgcctgcccgtctcagtgaggggaagctcctgagatgtctcccaacaaaagcttcaggcaggcaaaggccattcttcatctgctcctgagtttttgaagctttaaggccagcaaccagccttggtggcctctgccgcactcagccatgagagtgggagcttcagggtaaggcgaacgccccacaggagtctctggaacatgtgagtctggtccatggagggttctcagggagggtgctgccattgggaagccgagcttgcaaacagtgttctagaagcttgctacaacaatggcatctgcaaagaacagcatcgtcgtctcttgggagctggcagaaatgcagaaacttggcaacagcccacacctattgagccggagttggcctctgtgaaggatccccaggtcgttcagtgcacactgaaatagaaactctttcagagcaggtctttgagcagagcccaggacacagtaggtgctcagtccgttttgttttccgaatggtgcatccatgaaaagagtcatgtgttgccttcttgttaaactgtgagcacttgccctcctgcttgcacccttggcttcctggatttccaccaagatgtgggtttcaggacacattccctcccttgtatcgcgctcccaagccctgtcgctcagtgctgaggttgctcttcctccactctgggtcagtgcaggggcccagggggacacaactactttgcgctgtttttcttttgaagctgggcacctcccacaccactgctcttcttttcatgttacagctgctgtcctccctcatgactggcttgccaatcttactccttttttaagaaaaaaaaaacaaagtctcctcagtcagacccagggatttggggtgactatactctggcgctgtcgtggacccagcgctgaaattccagggctggccgcacctccccaccggagtcaggagacccatggctccaggagctgcggggagagagtcttctctattcaacccagccccaccctcggacgcagccacaaggctaaagagcactctaaaccaagagtccattctgtagaactgtttaaaggatggatggaagaaactcttcagtttttcttacctttctagacagttctgtggttggaaagtggttgtggaagaaaatcacatctaacctaagaaagctggggagacaaagtgttgggaggggctttgctgagccagcaggcagccactcgaggtcacagagaccatagggtggtaagcggggtcccctgtgggatggtgagccctggcccaacctttactgtcccatggacaagactgcaccatccccttgagctaatctcccaccccatccggtttcatgttcccaagagcatcggactagggggtggcccctgcagaggggccccagaacaggggcaggctctgggaagggcacacacctgcacaggtaccaggagcagtcctcatgatgaatggataaagttaccgagatgtttaaaatattgatgttatcattttgtttccattttgtatggaagttgaaaatgtgttctctttccattaaaaaacatgaaaagtttagttattgggtgcattggttatgtgtgtgcacatctatgtaggagggggacgtccacctgataaacaaggtgacgccacatgcagatagagccactggagtcctttcctttccagatggcaccttggtgggaagggctgcaccctcaggccgaatccacaccacatgggagggcagagccacctggcttccctgcagcatggaggcctgtgcgcgagacgagtctgcaccaacttgcagagtgaggagctgggaaagtgtggctgctcctaatgggtgcacgggagccgccgtcccgcacaggcactggcaggcgagggcatcctgtgaccgtgggcccacaaggatgtgtgtggccggtgagggtccttctgattgggatggcaccggtgccaaattcaggcccagctttatgacgtgactaattggagcttgttgtgaagacaatgaaaacttccccagatggagagttttgccccaggatcaagtcacagatctgtagcagtgcctgggactccgcaggcaggccagtgcgtgcgctactcgcatgcctgtgtgagtatggcaagcctggtccccagtggtgggtggaaaatgactcctcagtcccatgtgtgtagagatgcatctgcctgttgaggcccttcgggttagtccactctgggctttcagaacgaagactgacagggcaggaggaaaggggtccatggagaagccccttggctcagaagcagagatgagtcaacaggatacagcctaacccctcctcttcctgggagacccctcggcagcggttcgcctgcctggctgctgcagggatgctggggatgctgaagctttggatgaggcattgaggactttcttctttgaggcaggagctcttacttctcctgccgtctgttgaagctgcctatcttggtggaagctttttgccttcactttcagcaccggccttcggctggggttgctaaggcatgagggatgcatgctgtctccccaccctcactctctgtctccgccgtgaaggcacagtgcagtcacttgtgagcagcctctcggggacacgtgctggtggccgcccagtgctcagtgacctgtggcactgctgaggggccaggcactgtgcttctggctgctgtgtctcctgatgagaatagggagcctggaaatccatgctgacattcagatcagggccccatctcttctggacttgcatacaacaacctgttggtgcctggatttcctgattttgaaaacagttttcagtaccaactcaaaagggtcacaggaggactaagtgaaacactccaggcctgttcctttggggagaagggaatcatttgagcccagcctcagcattattgctgccatgattgctgtgtaatgatgtcccaagtgcaggcgcgtggcaggtgtgtttagaacgtgctccgatgccagtgagtgagacgaatggaggactgcgctcactgtgccctgctgctgtgtcttcctctataccctgtcaagtgggcagagaacactggggtccagaaagctggctcccaggtatttggagagccccacggagggctgtgggagggaacaggcactggtttgttctctgagtagcacttaggaggaagcaaatgaatacagccataaaatagagcaaaacagctgagcctggttggaggaaacatttcaaaggaaataaccctagatttagatcacacatgttggagcccggagtgaggtttttcataacctccctctgaaaggcagatattcgtagtggaaatgctgacagccatgtgcctgggccgggtctgaaggcagctggaacctgcagccaccctgctcctgtgatctgctcggcctgcacggagcagccctgtgatggggccaccctttatcatgccacttaaactcagcagggcttctgggttttttgtttttgtttttttaactcatcaaggtgctaccagctgcaaatgctagttctgaatctgggtgagacctggtgtttcccttcactgattgacagcattgaggggaatctcctagaccaggctgacgtcagacttgactcctggtaggtgtgggggacaggcccctcctggcacctgcgggcctcacatgcaagggcttagcctatatccttagcctatgccaagcttacacccatggctggccacagagcgggcgtgactctgccccaggtagcctgcacttccatagcggctcacatggtccttcacttgcctgctgtggttcccaccttcgtggatctcactgactcactgcctctctcctcttcctttctgaatcctgtacgtccttcctgaccactgctgagtcccgtttttcccatgaaggcttcagaatgccccccggtggcctacctgcagttttcggaaagccctttggccactggcctaggtgcctctgtggtgccctacagcacagagcccagttgtgctgctgcagagaccctgtaggccccaaacccaaaacagtaccctggcagacagaatgtgccaggcctgcacacaaccactccaccctgctcagtttccgcttggtgaggagaaaactcagagacagctcccgcttcctcctgccctgagctctgtgctcctccagggagatctgcccagagggcagctggcatttactcagtttttttctgctacttctggaaaggtgagggagaaagagtggaaactcacaggcatttacccagcctgatggcatttgcctaacccagcttgtagcaatcatcccatgatgattctagtatcatagtttcttcccagccacctctgtgtacacaataaagagttccctctgctttattctttcaaatcactgtgagctccccatataggtgtgcacttaggctgagccaagtacagcctaagaaggaaggggctccattgggcacccaagtgggaaacttcctccaggtataggatcaggggacactgtcactcacagatggtgaactgacctaactgaggccctgaggaccagcccagggagccttttctcacagctggtacctccccaggctgtgtaattcacggaccttcccccagtgggtgtgcctgggctgcccctcccagcccctccaggtgatgccgcagccctgagaggaaggatgtggcttagccggccaggagggtttattccccggttgctcatggacttgaaccttcatgccacctttcctgataaccaccacccaggatcagactttcgtcaaactcttcactgcgcacaacgcctgctatcttgtagaacaatgggagatgtgggaaggagtcgtgtcctgagacctcgccaaatcactcaagatgacagattattgacacctcctggggtatgctcaggccagcttctggggcttgacagcctgagtggaggcggttactgaaaagagcttctgtggtttatgctgaccagagcagactcccctgccacagccggtcaccagccattagaaagtgcattccagtcacatgctttgaaatctcctccggggacctgcagtgctcagggcaggctgggaacctgctgtcatggagcatgcagggccagcccacgtcttctgatatggggcttccttcccatcttgtccctagtccctcactgtctgcaaggcggcaccgtgcatcccagaaatggccagcagttgaaaagattggggcgacaaggtagtggcccttggaaaactcttctttctctatgagtcccctctctccatcatggctcctggggtttttgagctgctccaaaaaccttttcaataaaacctatgccaccccaccagcctcttctgtgttttccctgcagtctgacggatttgaatgcattgccagtttgtgaatggaaatgtggcctggagagtgcagagggctggtgtggcatgtgaccatgatttaatgcagcctcccctctcccctttctcactcagctcaatgactccgccaagcagctcattgagatggacaagccatgcccagccgctgcatccagctgcaatgcctccctgccctctgactccggcgctgtggccagcgtggccccaagtcccactttaagcagctcaggggcggtcagtgcctttcagcggcgtgtggatggcaagaagaacaccaagaaacgccactccttcaccgcgctcagtgtgacgcacagatcctcccaggctgccagccacaggcattccatggaaattagtgctccagtgttgatcagctccagcgatccccgagccgcggccaggattggagaccttgctcatctgtcgtgcgctgctcccacccaggtaacatcccgcgggccagggcaggcatccctgggttctctggggttctatcctcagctccgtgttcagtgtcccccgttcctcaactagcatggaggccgccccagaactgccttttggggttgagtggggtttgccctttgctgcctggcactggggcccccctagaagcgtggagaatggtgagtgtgccctccctggttcagaagatggcctcgtggtgtgtgagctgattttcagtggtccagggaatgtctgagtaacacccacccgcctcatgacaagcttttccccgtgtcagtcggcttccagatgtctgattatgtcctggaagagtcttggcttagtgctagcatatttttaccatctctgcaatgtttgctaatttccctttcaagagaaagaaggagtcagagctcagaatcagaatcaactacattgttgagtactttcgttactgttgtttctacagataccttctatttctagactccatttccactagttttttttttttgtaaattgaagtaaccaaagcaaagtatttaaaggctgggcacagtggctcatgcctgtaatcctggggctttgggaggccgaggcgggaggattgcttgaggccaagagttcaagatcagcttgggcaagaccctgtctctacaagcaaccaatcagtcaatcaataaaataaaataaaatgattaaaaaaatttttaaataatgaacaatatttagtaagtacttgcctgtagctctgacaagacccctcacagtggcatgcacagggcaggagttgggcaagtttcccctttatgaatgcagagactgcagcaggagatggaaggggctttcccagtgcccggcagggtgaccctgcagccacactcctgtgccattgttgtctgaccttctgcaggactgtggcagatgtccatgggtgagcccaaggtgcccacacaatggtgcccactccatttctccctgcgctgcagccttccacccagcggcccacccgccaccacgctccacattccttccagagtccctctggctgccctggacaggcctcagagcaagggcgctgatctgcggggaatcatggggcagacaccaataagcaactggctgggaagaactgtcttattcaaaatcacaatgaactcagacaactttacacacagaattgtcttaaaaattgctgagcttctggagaagggccatgtaatctagatgtgccacatcagcctagaaatgccccctacacacacttgcacacatgcacgcacacacacacatattacatggacacttgagcacatgcccgcccgcacatatgcactcccacgcacatgtgcactcatacacatggcacacacatatacctgcacacccacacatgtgcacttacatacaccgccatccacatgcacacctacacatatacacatgcacgcacatatacacatatacacctgtgcacatatgtgcacttatatgcaccccttccacatgcacacacatacacatgtgcacacacatgcgtacaggtgcatttacacatacacccctccaggtgcacacctgcagatacacatgcacacacacgtacgtatacacatacacacctgtgcgcacacacacacacacttgtgaacttatatgcgtcccttccacatacacacccacacatacacccgtgcacacatgtagacatttatacatgcgcacacacacattggtggatacacacctgcacgcatatgtgtgcacacacacaaacgctggctctcatcggcggctgaggctgaggtctggaatgggtgctgtagtgtctggagctgtaaccgtgcagtcatctgcccccatggttaccccactgcctggatgctcccacagcctgtgcctgggagccatattccccagagaacagccattggggctgctagtgcattttctgtaaggggaaaagcataaccttggtcccaaccctaactccactcctgacctgggctaaattcttcttgagcacctcctatttggaaattcctgggaggggcatggtgacccagtggcggaccagtgtggctgtgctccctgtgtgtgtgcacatctggggggtaaagccacaagcagtggctcttggaatagtcttgcttattcttgctcaaacatccttgacaccgggcaggttgtcatggtggtgctaagactggggggagctcaccctgtttgtcaccaatgacaaagtgtgataactttggcccagagctggggtccctccttggcaacctgagcaactgttggcgatgtgaacagtcgaaagttgtgttgtgaaacaaatttggctcaaagggaagttgcagcaggtttgaggggtacccctaagaagaggactgaggagcagcggcctggcccttgtggaccacttgggtaggtcgtttgtctccttcctcctagaagagcaaaggccactctcactgtagtcagggacccccatcaaccagagggagggcccttcttcctgatcaccagccagagatggccctggaactgccaggccagtgcctatcctgacaagtatctggcctgtgtcctgtaatttgtgagtaatatgtccaaagctgccctcggtgttccttggagttctaaaaaaggagcccacagggcccatgactttgcaaagctgctgctgtgtcccaagagggccaggggcatcttctctgccactttcccacaggcccctgagatgtgggctcagcacacacaggtacaggatccggtttcctctccttcctgcatcctcacctgcaccagcctctcatgttgccatggcctccgtgttaaaacaagcagagggaacctttctaagctctctgcagtctgatgtctattggggctggaagggaacagatgtttctattaatttgcatactacctggctccacagggattagaattagggattgacgggactgggatcctgggatccattttccagcagttcgacttgaagcgaaagtcatggccaggctactgactttagtttgggtcacctcaaagggcaagaggtcaaataaagcagttgccgcctgtctccctgtcctgatttaatcgagctgccgggagacagaaggggcacctggtgcaggtgtgagctgtgtatgctgcccctgcgggctccagtgtgctgctatggtctggatgtgcccagagaccaagccctcccggtctgcccctgctctgcactgccttcctggttcctaccaccttgctggccatgtgcgtctgaccaggaagtgcctggcctgaggactggcccatggcagccaaggcgagccagactcaggtcctgctgtgaccacagtgctgcagggattctcttccccaccatgctggccacagcccaggagagggagcccaggcccaggattctgtggtcagtgggtggcacttcggctttgatcatcggcttggagaaattcagcattgctgtgtcatgggctcatccacaaacagaggcccctcacatgccagcactgccatcgtgggaaacgtggagtggacagagcaggaaggcccgcagccccaggctcctcggtgcctacagcatggggcagtgctggccccagcaagggccactgcagcagccagtcccctgcctctcacagtcccctcgggacccagtgtgtccattcaggctgtgataaagaacatcttgactgacaggatgaattcttggcacctggagactggggctgtaggggaagacaggatggtgaagtgtacaaggctggtcatctggaccaggacttctgggccatggggggcagaggattacagatcgtgggttgtgtgtcccagtgcatttacttttggggtgagcatggtatcgtccctggtagttattgaatcctcattgaacgttgcactgggttctgtagaaaggtccaaacagcaggcgtctgccctggaaaagcagctggctggagtggagatgggctgcttgctgggcactgtgctgtccaacgcatcgactgcagttgatacacagtcagggtgggtggggggatgtggatgaggaagccccttagctggccgaattaaggggctctcgctgtaatggactggttttgctctttctttggtgttgtcttaaaatagaaaggaagcgtgcgtctgtggtttctatagaaatgcgtctgaggcacaggggacacttccctgcttctcagagtgcccgagcaccatgaagcctgggagcacagcctgagagccgcgcactgtccgaggctggcctcctccccgcagctgttaggggtgcgtctgtagtttgcctgtcccccatctctccttcggcttcttctgctgatctcacctcctctgtcctggcttgcatcacttctcagcttccccgactgtgtggcccacctcaccccacagtgagccaattgttcattgtttccacttcagagatgaggaagccgaggccccaggggtagtggtgacacctcagggctgtacttctgtgccagccctccctggccttccagggccccactcttgtcaggacatggttatcacttaactttccagtttactccataaaatgcacagggctgacctcaggccaaaggagacacgcaggagaatgccagcaggtccctgcggtgctccataaagtgcccctgctttgcttttcttttaggctgaggccaggctcaatgcagggtgctggggtggaggtgcaggctccctctctctagctgtgtcaccccaggagagttgctgaacctcttggagccctgcagttaagagccagcctccagagccagacggccaggttgagcacttatccttgcacctgcaaccttgggtaagctgcctgacctcttcccaaaaactcccctacctgtctgtggaatggagccaagctgtgcgcccccaccatggccactgtgagggtggagtgagggcgtgcgtgcgggctgccctccttggtaggtgtaccttgagtgttggctgtggtggctctttctgctgctcagggaatcagggaatgaatcaccagtccaagacaccaggcaccagacacatcatctctagtcactgctttctgctccaggagcccatctctggcttggtgctgtgctgggtcctggaggttttggaaagctggtggtgggtaagaagtgggtgtggccgagaccactgcaggatgggaaggaggggaagtaaaggaaggagaagaaaaagtgtcagagactgacacccacacagcctgaaatatccactgtcaagctctttgcaggaaagggctttaggctgaggctttgttgatgagaatgctgaaaaggaagagctgtgaaaccgaggagagagctgggagctgtgtaaggtgagctcgaggcctggcggggagtggggtgccgatgcagaacaggccagcgcctggcctctgagtagccatgtgggaaatgctacaagttcgagactgggagtctcagcagccactctgcaggggcagggacaggggacagaaagatgggggagtggggcctagacggaagttttgccgggcctaggctggccacaagcacagtcaaggtcgccaaggagctgctggggctggccactgggcacctcccagaggctgccacgggcacacagggcctgggcaggtggggtgtggcccaggctggcggccaagcagagctgacccctctcccaccgggtgccccctcccagcacctttgcggaaggcccattctcattcttctctcattgacctactgcttcctctttcccatggatgtgctcgactctctgcagtccgatcttgcccaccacccctgctgctgaagctgacccagccacagttaccaatgccctgtccagcatcctccttcctcatccgccatcttgacctcttggcagcacttgacgctgtggacagcaccccttcctgaacctgtcccctttgatctgtgcctcttctttccagtggagccccgtcctggcccctcctgccagaccctctttctaacccctatgtctacacaaataccccccaccttctcttcccctacatctctagcccctacatctacacaaataccccccaccttctcttcccatcctgggcatactcacccatgggggttcaccctctccagaaccccagccaacgtcacctgccagcacctcttttaaactacagattctcttctccaactacctgctggcttcctggagagacgcctcaacttcagcgcatgccaggagcaaccgatgacacccctctttccgcaaacctgcttccccttctgtattccatctgttcctcaaggagtcaccactgtccttaggtgccctgagctaacactcttcgtcttcgctaatacccttcgtcttccccaacactgactccctgcccctgagttccctcctgagtcccttggaaggttctggggagccttcagactggcccttggttgcctctccagctcccggcagcactgtccattcccgtgagcctgtgcagatcttctccctgcgcaccacgctgctctggccctggtccatttctccccgaaactgccgtagctaatcccttcccacctgcccatgtcccttttgctgcccctcagcatggcattctacctaccaggcaacacacagacacatacctgtgcagaaggctcctgcccgcccttccagaccatctgacatgttcacctctccgcagctttctatggccccatgtcacctttccaccaccaaatcaattcccccactgtctctttgcctacaggacttccagtgtgcccatgatggaatattatttgtgtgtatggccatccccccttcctccctgggcttttaggtccttgaaggcagggctaggtgccactggcccacaggtggggctctcacacgctagcttccttgttgggtgggccacaagacagcaccggcagcattcctcactggatggtcttgtacataaagcagcatggtacctgagagactgtgtggccttccccaactcccgcaggcccggctgcacatcgatggctggggagaggacacagctgcggggctctggctgaaggtgtccagggcgtgcagccggctgagcctcagatggcccgtcctgctcatgtttgcacccctagggattcttcctctgcgactgggagaggtcagaggctcagctggtgctctgggcataatggagtatcattcacatgtcagtgctctgctgggggagggaggttaatcagaggagagggaaagaggccattcaggccaactccactatgacacatttgcttttgaggttactggatcaaatcgggaaatgattgcttacattttagaaaaatttcctcataaaccaagtatgaagtcaagcaggtgcccgaggaccctaaatgggcagtcagctctggagtgcccaggtccatcactgagagcagctatatcacgtaataagcagcccacgttctcggaggcaccaagctgtgaatgcttgcttctcactcatactatgagtcaccggtagaagagggcttggctctaccatcctcacctgggacaccaacaaacaccaggctgagtctagccactacttgttttggtaaatgaaagctttgctggaacagggtcacacacgcccatttgtatatcatccgcagctgtttttaggccataacagagatattgaggcgttctgacagagattttaagacccacacagcctgaaatgtttattactgagcccattacagaaaatgccttctgactcctggtgtagaatgtctccaggaccatagcaggggcagaaatgaagcaaccagtgcagaggctacatggaagcctctgctcatgcgcatttcagtggtcgaagccaatcttacagccccgccctgttgaggggtgggcacatggagtccagcggggccttgaggagaaccgtccccaggtgccacttccctgcaactcagcaagtttgcatttctgagcacagaagttgggaagcttcaaaggaagagacgacacctttccaaagtaaggctagtgtggctctgacggctatgcttgcactgctgtgtgcaagcatatacccactaatactgcccatgagtgtcctgcctctgggcaggggctcttgctgggtccagagtgtggtcagatgcaggctgactcgccgtccagccaggaccagcaccttcattggcccttgccagcttctctgttctggagagcaccatggcttacaaattacctccaaataagcaacccttggaaattaggaacataccctttaaaatcaatggaaggggaagtgtttgaaattcagcagggagaacatcaaaagacagcatttctcaagtctcttcgtgtctgagaagtaaatgaggagagttccttatggaagcttctgggcaactttaaaatgcatcaccacctgctatttgtctctatgcagcttcctgtgttggctgggtcttattatctctgccacaggacagacagacagatgcttcaagcaggaggaagtgctggggaaaagctgaaggagctgaagcaggaccttcctgcctcaggcctggcagcccccagacttactgcttataagctgtgcaaactccggctccagctccagctctcaactgcagagtacaagctgcctgcatagcagagcacctgggcttatttttagcattttcagaaagttataaatttaattacatgccttatagggaggcaaaacaaagtaccaagtgagcctgggatgaataaaaaaaaaattgcattgtgagaatcttatacaagaaaactttcttctacaaatctggaaatagctgtacctccatgacttaccaatcctggcctttaagtggggacagaggacaccgtggctgcctgtgacctggcgtcctgatgatttttgtcgattgcaaagcttaccaatcacagtgcagggtgctggcagtgtttcttttgctgctatgacgagctaggaaccagatccacgggtttctgcctgtgcctccaggccatccttgggcagagtcaggaaagatccttgggtcttcttggcatttggagagcatccgggagctctgggtgggcacttgctggctagcagcacagaagagtcactcccttgtcctagcagctgttgaagccacatcctgcagggatccacagagggttgttcatgaatgcccaccggtaggccccatgggacccaccaggagactagcacacagtccatgcctcagagggtggaaaggaggaagggcctcgatcagtacaggtaaagcaggaggaaaccaggccactgaggtcggtgtcctcagggctgtaatgtgaagacccatgatggccctggacgggaggactgtgaggagctaagaaccttctccacccagatctcctgactgcctcaccctccctctgccagagctcatctgccctcccgctccaggctaaaccacctacctccccacaggcattatctggatgcagtgtgggtttgggaggcgagaaaaacggggtcccacacgcgctcacgcccaggccgggttcgctctcaggacctcgtcctcccattcgctgtcccctctaccagcccgtgagcttcgctgcggcaagagagtgctttccctctctgtacaggcaatgccccgcactggcactctcagacagaaggatggatagacggacacactgaattagagctgaacaaaaggatttttcaaagtccacccctcctgcagccaccgcctgtaaaggaggcactttctgtttgaagacagaatggatgcacagttggatgtggatgaatattgtgccttttatgcaaagctggatggagaagcctctggcctgatgggtgcgcacagggaggggggtccagggccttcctaccatcagaggcaacaggcgagtgagagctgtgaggaaggccatgagcggaggccatccacggctcttcctgatagaagaaaggctccagggcaagataggttgcttcttagctgaggcttgggaagccccgggtaggcgagaaaggggtcctataacttccttaacagacctcccctttccttgttgacgttttgagattttcattcaccaaactggagtcgggttgtggatgttctcctcccatattccactgttttgatccattcgccttagtaatattgtgggaattccttgttaagcttttgatcacaactttcactttttggttccagttattggcccagtaagacaaaggcagaaaggggaagaggttcatcttctcatcatagacacctagagcaggggcagcaaacgttctaaaggaagcagccagatagtaaataatctagactttgcagccaggtagtatctgccgcagtgactcagctccaccctgcagtatcagagcagctggagacagcagtggatggtgggcatggctggctgccaataaaactttattcacaaaagcagaacactgggccagatccaacctgtgggtgagaattaaatatccagcagcaaatttggaactcctacgggggcaggtggcttgtgggcagcagtggaggggagttttggcctccatcttcagtggtgagcaagcagttcccctcaccagctgagagtgctgaagttatgtgggcagaaggcgtggctgctgcctctcccaggacagactccctcactggggctccccggccactgccctccccgagagggagatcgagaggcacgcggggcctctggctacacaagctgcttgctcctctttgcagaatcaagcagaagaatcagccataaatgttttattctagagttttctttgggaagcaagttcatgagggtctgatttacaccccgtgtaatggagtggtagcgagtgatgaataatgcatgcccatttcactgctccttggggtgatgacagtgttttctggacttacattaaacatttaaatgaggagatgtttcttcttggggtcttcatctgttccatagtgtcaaagaaagagactcggagcccccgtacagcctgccaacgcccagaccctcttttttcccttttagtaatcccagcagggaactaatacggcctggttcccagccactgcttaggggccccattaaaatgcagcggaggaggctctagtgtctggttacaacctggcggtttagaatcggggaaccgcggccacagcactgcagccattgctgacaccaggcttccaaccaggggaggctggaatttgatgaaacacatcgccgtcacagatgacagcccaatctttactgactagcagctccagcgctgtgtgccattcacctgtgagctctgtgacagggagagagatgcaggagcaatggagcttgcctggatccagggcactgcacagtcagactgagctccagccctgacctcggtgcggagggcccctgcagctccgtgcacccagggggcagcatcagcgtgcacgctgtcactttactgtttgcttgtgctaagttccatcagacaggccatcctctcctacctgtagccctgccagccgaccttgcactactgggctcatgtgaaatgctcacaggctgtgttgttgagcatcctgcccgagggagggattgctggagttgttctgtagggtcagtgactcagagaactgggccactgcatgtcagccagctccttcggaacatgtgtgtccacttgcctaggccaaatcctggcaggtatccattatggagccttttaaaaagaccgtggtgcaaacgtactttattatagtcagagccctttcctgggcatgggctgctaggcgcgacttcgtgggagacagggctgcacttggctttgaagtcggagcagagatttccattggatgatcttggagataggatgaacatctgtctgagggctgtgtccccagttatttttactcaaaggcacctggagctctttctcttttcttgttttatcactggctgactccctcactcctgccaagtctttactaatcccttaaggcctagaatcatttaaaattaagccattaaaaatcaaagcagcatcagagaggtggctcgtggttaggaggaagccaggcctgcgtccagggccaagcaccatggttggagctggaggcaaggagccctcaagtccctggtgtcacagtcagcaactctcaacctcgttatgaatacttcaggggagaggcgccattggttgggggctgaaagtacatccaggcagtgcgcagctcaggctttgcaggatgctggccgtgtggaagtctgtgcctttactcaggagttcccaattacagtcatttaaaggagaggcccctttccctgcagttagttcctgccagggttagcagtggctgctcatctctgcccctcagcaggcctcgtgttcttgggagtcacattctgtacagctgggcctgtggcccccagtagcgtgctgctgagcctgtcagtgggaggacccctgaccccctcccaccttggccaccagcaaattgctgctcgtttgcatccgtagcaacagagaccagattcagaggatggactgaccccatcagcatcgggaagccacgaccagtgtgccactcatttctttgtacttttagttttcatatccctgagggcagagcccagcccagcgttgcctcctacacagcaggatgtccctcgcacccctcgccctgggtaccacaccacacacccatgctaggaaggccggccacacgggagccacgctcagccatgtcagttttaggcattcttcatcttgacctttgggaaaaagcatttccacacatctgacctctctctgctcttcattccagctctaagtaatagcttactgttaaatcccacatatttgcttggagcttttgccatatcaagtgtcagctgaaggccaggattccagtgaagccggcagaatgtctccctcctgctgtctttagggacagcctgtgtcagggtggccaaggccccagacccctgaatgggccctgtggcagctcccactgtccacacctcaggttccttggctgagccctcccgagcctcctgacaccgagccctgtgggttgctttacgttggactcacgcagggcagtcggtggatgccggcacagatgggatggtgagccttcggccgccgtggtccacgatgcgtgtgctccgcacagtgtgcactctcagcctagccttcagcctctgcccagcagacaaaacacagtctccttggtctctcctggccaaacacattgcccccctttcattggagtatggcttgagcagctccaggacattgggaggtggagatccaagtgccggggcaggcttcaggcaggccaccctcccagtgtggccccagcgtggctctggctgtgctttgcttgtgctatgctggtttgggacagcttggctgtttctggagcatttatctgaacaggacagcaggcatggtaacaacagcaggaccagtgcgtgcctatcatcttaggttcccactcttcccgctgctgcagagcagagtgccagtgcctgggagcacagaactgccagcccagcccctgctggtgctgcagggtcacccctgccctttgtcagctcccaggatcccctgacaaagatggcacatgggggatcgagaaagatacgggcttaccgtcagccagacctcaagtgttaactctgttattcttctcataccactgtggaaatgtttcaggaaaccattgtcacttgatattaaagtgtagattaaaaaataataaaattatcccaaaaggcaactccccaaaggagcaaagttatggtttggtatgtaagtttcctgacttcttgccatgaaaatacacgtatcactgtcagaaattagataagccttcatatgcaatgctgtcacctccatttccactctgcataccctacatggccctccaggcctgtccatggagaccacggcacaggcggcagtggggcattctgtgtccttgtcagcctgccagccccacaccctggaacttcaggagtgcaggtttttcgtatcataaacagtgctgctgcgaaatccttacctgtacctcctttctgacttgtctgattatcattattttatatatatattttttgagatagagtcttgctctgtcgcccaggctggagtgcagtggcgtgatctcagctcactgcaacctccgcctcatgggttcaaacgattctcctgcctgagcctcccaagtaactgggattacaggtgcttgccacaatgcccagctaatttttgtattttagtagagacagggtttcaccatgttggccaggctggtctcgaactcctgacctcaggtgatctgcttgccttggcctcccaaagttctgggattacaggcgtgagccaccaccccaggcctgtctggttattttaggattcattcttaacaggaaactgccggggctacaggctttttttcctgccctgtctctgtctgtctgtctctttctatctctgtctgtctacctctgtctctctctgtgtctctgtgtcttcctgtctgtctctcccgctctagaatggagaacagctttgtctacaagcccaaatcaccaggacctggggctgtatgagaacgtctctggcccccacattcccctccctattctgtgctctggggcagcacgcctgcccccaccagccctccacacagcatagacatgtcatgagggccatgccttgtaggacctgagtttgcagacttctctgttactaactatggcagaatgggacagaaaccaggggactgtgggtccactggcccaagccaggagtgagggctttccctgcagggagcacactggggtcttccgcatcccatgagtgggatcaagaggtgtaactccccaccagtggtccagcaggggcagtcacctgccccaggaagcgcctgtgcatgtcagcattcccaagaccagtgggtccttctaggtccttggcttccttggccattccacagcatgcagctcaatggacaatgacattccctctgaagcaccatctcccctgggctatgggtctccttctgtttattgggctgccccatcttggcctccttcagggccctcttctgggtggtgtcccgcagatggggccagggcatgctccctcctcactgtctcccaggccactgcaccgtctaccctgttggcttcaggacaacgatcacgagcctttgttgagggcctattctgtgtacttagagtgactgctttatagcctgtgggttgtctgacttcatactccagctgtctagaccatgcaagctgccacaaccccatcttctcatgtcttggggactctgtcctccactgcttgatttctatagtcttgggagctattgattcaggtttcatctggtttttcagttttttcaggcaggagggtaaacctggcccctgttaccatcatggtcagagcagaagttcatgaccctcaatggacacgaggagcaatcagaggctcacagacgccatcttggctacggtcacaaacacaggtcacacacctgggagctaagggctttgccacaagactgcattgcctcatagatcagctatacatacatgaccccagatctgctgcccaggccagtcccttctgagctcctgattggcattaccagcaccctcatcatccacactgagacatctccaggcacaccaaacactgcgtgtccagcactgagcccatggcctctgtggtctcttgttcctgtctctccagcagcatttccatctggccaaggctagaaactcggcccatgctcctccctcaacgtccttcagacctaatcttgttggtggagaagggactgatggcccccacacatgtccaagtgctgatcccagaacctgagaatgtgtcacctcatgtggcaaacgggaaaagaccctgagatggagatgctcctggatcacctgggccaccgcagccacaaaggccctcccgagagggaagcagaggccagagtcagggaaggggatggcgtggtggaagcagaggctagagagaggaagacgtggcactgcttgccttaaagtggaggggaccaaggaacgtgggcagcctctagaagctgcaaaggcagggaattggagtctcctccagactcccagagggaacacagccctgccacaccttgattttagaacttctgacttcaacaccttctgagtgattgtaagcccctgagtctgtggctgtttgtttcagcagctgtgaggaactaacaccacggtgtggtggctaagcacgtggcctgagttcaaaataataagcaggctgcctgagttcaaaatacccatctgcaggcttgcgaaggttgaaagcattgttccagggggagtgctcagagctgggcccagccatggtagactctgcacagggcgagtgctaccatcacgggtgctacagtcgcggctgctattcctactaacagccccctgagcgtgtccagaccccctcctgactcccttgccctctgccggtgcaggctgggctccctcgcacttcctgatgggttccctgcaaagctgcaggtcctggctgtggctgccttctccctgcctgtcctccagggacgccgtgccctcagactgaagaccagaacactctcaggaggccccacgcagcctgtcctcatcccgtggggatactgccccctttgcctccaaaccgtcacttcatctggcctcccaccttagccagcctgggctcctctaggcccaccacccaccctcaccacctccctgctgtggcttgaatgtcccctctgaaattcatgttgaaatttaatcccccaggcgcagcactgagaggtggggcctttaaaaggcaattaggtcacaagggcaaggctgaataatcactcatggattcctggattcatgggagcagggctggtggctttctaagaagcagcagcaggacctgagccagcatgctcagccccctcgtcatgtgatgctctgcagagtccccaccagcaagaaggctgtcaccagaagtggccatgcagcatcgcacttctcagtctccagaactataagaaataaattcctttttgttataaattacccagttttaggtattctgtcgtaagcaacactaaacagactaagacattccctaacaagactgcctcatgcctttcgaagccctcccagccacgcccagcccaggttgggtacctgtgtaaggggcctgtgcacgctgaacttcctagggctgctgcatgcttagaattacatgtccaggctgggtgcagtggctcatgcctgtaatcccagcactttgggaggctgaggagggcagatcacctgaggtcaggagttcaagactagcctggccaacatggcgaaacccccccgtttctactaaaaatacaaaatatctcggctcactgcaacttccgcctcctgggttcaagcaattttcctgcctcagcctccccagtagctgggattacaggcgtgcgccatcatgcctggctaatttttgtatttttagtagagacggggtttcaccatattgaccaggctggtctcaaactcctgaccacatgatctgcccgcctcagcctcccaaaatgctgggattacaggtgtgagccactgcactggatattgtgccactgtactccagcctgggtgacagagcaagactctgtctcaatacaacaacaacaacgaacaaaatattagccgggggtggtattgtgcaactgtaatcccggctactcaggaggctaagtcgggagaatcgcctgagcccagaagcagaggttgcagtgagctgagatcgcgccactgcattccagcctgggcgacagagtgagacttcatctcaaaaaaaaaaaaaaaaaaaagaattgtatgtccagtgcttggccacctggattgcaagccccacacagtcacaggccatggtgttccccatgggggcccagggccagttccgactgccaggtcatcgagtgtcagtgtgtcgagcctgttgtccctgtgttggaattgcttggtaactatttgaatgggtgagtgaatgaccctaagatcctgcccacacatttcttcagtggccacaaggagacctgtggacagtggagaaagcatcctctgcgcagatgcctggggctgggagggcctggtggagagtgaggtgacagcttctccttctccctcccttggggtgtctctgccctcgtacttgccctccagcccccacctacacctccatggatggtgactcatgatccagaccggctctggggagttctctagaaggaaagtgatcctggcattgttggggacacctcctcttccctgtctcccttcatggagagggcaggtgtcccgggcagacagaagaccctggaatccatccgtgggaaggaatgcccccttccagccctgttctcacacggtgctcagcctttcctgcttccgcatgtggcatgaggcaggcacaggaccctccacaggaccctcagccaggcacaggaccccgacagcctctggacacctggctctctcaggatcctttgaaaatcaaaggtttttctcacagtgtctgcattgcaatggaagtcatttgagacttggagttaccctagagacaccaagggagtctctcggttgcacccgctcattctgccaggcgcactgggtttaaacaggaggaagaaatcgtttctgactttgtagacactgcccatgtagcatggtttcaggctctgctatgattgctggtcagggagggctgtaaccactcagggaggggcaggtaggtggccggcggcatgcagaggttatcagctaagcaaggccagaactggtcagtgagtaatgagaaagctaagcttcttgctcctaagctaagaaggtggtgtgaggccagtctgggggcagggctggccacctacctggggcaacttccaggtggctctccctcccatctgtgtggtctctgcttgtagtgcctttcgctcacctgaggacacacactggggacacaggcaccttccccattcagagccaggcagcctctgcaccccaccaaacctgcctttggccgaggtacctgcagcctggccccgtcctgtgctccagtttctgctgggacccctattctgcccctcgtcaggcctacacgggatcctagaggaagggaggagacccctgtctccctccttgaagggaggtggaccccttcctcctccaggctccctgacagcccctctaatggagtgtcctgaggcttccagagcagtaccacaaactaggtggctaaaagcaacagaaagctgttctctcacagctctagaggtcggaagccccaagtcaaggtgtggacaggtttggttcctcctgaggctgaggggagtctgttccggggctccctcctggctttggtggctgccggcatcctcagcacccctcggcttgtggatgcatcactcctgtcactgctccgtcctcacatgggcttccttcccctccacatcccggtcctccttctctgtgttgtaaggatactcatcattggatttggtgcccactctaatcaaggatgatctattctcaggatccttacctcatatctgcaaagacccctattccagataagaccacaagcactggtgccagggctgggacttggacagatctttgagaggtacacaggtcagacccttctgccattgaatgcctctgaacaggaagacaggacactgtcctagggaaggccagggcagggcgagcaagctgggtcgtagggggacctgggggcagtgctgccctgcatgggctgggactaaggattctctatgtaggaattcccttggcaagaccatggtgccacccagattcctccctcggcccccccactgtccccagagagcacagcgcacccctgatgctgaccgttcctcgggtcatctccttgcttaaaaaacccttgaagcttggagcactttggggtcttggggggaggggggcaccctgtgactcccggtcctcttggcctgctgctctgtctgctgtcatgggaccaattttctttagggattaatctccagttcctggggacgctctttttaaataagctctgtttcatagcatgaaagattttgtgtgggttttttttaaacaaacacaataataattaattcaaggtctaagaataaagccaggtctggaacacggcctgactacagtgtgatgctgaccagcctagatgcaggccgtagaaggctccctgagctgctgggaaggggctcttgaaaatcacctcagggcaggggtcccgggctgccaggctccctcccatgacagtccaggtaggcacagcacgttggaggccaaacagccaggcagctggcgaagcacaggcacctgtggatgcagcctcattttgcttttctctttcccttggatggagtctctgtctcctcactcctgtcccctcttgtctgtttccaggatgtctcctcctcggcgggatctacccccacggctgtcccacgggctgcctcggtgtctggagagcagggcacgcctcccaaggtccagctgcccctcaacgtgtgagctgccctttgtgtctgtcggggtcctgtgcctgcagccctccctcctgcctgggctgacctgtccacgtgtggtttccgcagggttttcccatgtgttactagttggccagtatagttatgtgcgtctaataacaccgctgaagggagagtgtggaagacaaaagtctagcggttccttctgatgtcgttgtttctaggacatttcttctaagcagggaggatattcagagtattcacagtgcagttcccagtcaacaggagaggagccagccatagtgtggagcaagctctccatagcatggaaggtccgagattgaggggagaggcgggagggaagcaggtgcgcagagcagcgggtagtctaggagcttgggtagccactagtcaccaactgcttggaagtggttctgtgtttcagcccccgtcccagggccacaccagcgcatgccagctgcatctcatccccaaatataaccagatgaatcagtgctaggaagtgagatgtttatcttgtttagaaaatctgcccagttaaattacagctcttaacagataagtgcaattttaaaattccccatttaaatcatgctctgaagaattagactcccttttgctcttgtgtttggcagagctcagtcacttgaatgactgtgttagggtgaagtctatgaacttggcaaacaagatgacataatacagaaagttctgtgaatgcagggtgggtagacgtcagagggacactcagaacctgtgttgttacagaacaggattttttgttgttgttgttgtttttgttttgttttgttttgttttttgagatggagtcttgctctgtctcccaggctggagtgcaatggcgcgatcccggctcactgcaagctccgccccccaggttcacgcaattctcctgcctcagcctcccaagtagctgggactacaggtgccagccaccacgcctggctaaatttttgtatttttagtagagatggggtttcaccgtgttagccaggatggtctcgatctcctgatctcgtgatccgcccgccttggcctccctaaatgctgggattacaggcatgagccaccgcgcccggccaaacaggatgtatttcaagcaaaaaagtattttgaagagcaacttgccaagcttcaaaaggtctagaagtagctcagctgctggcacacactcacccacctctaagcccagtggaaacaccagcctttcttaagtggtgggcaggaaagctcccaatatcctcctactataattaaccaatgtaatgaaaggtatttgaaatgtacctattttttacctagcttcctgagcaggctacttccagatgccttgagactgatattcaagttttcaccagcactggacaaaagatactacctccatctcctgccatgctcctagctcagttctggcagcttcaggcaaagctggtgccaaggaggcacatggaaaagtggggggtgatggggctgctcttcttgaagaattggatgcaggatgctatctgaggaaagaaacctgcacccacagtgggatagccctgatggagtttcccaaatgagaggcaggatgcaggtcaggttgctgaggccatgagtgcttcaagggcaaagcccagatgtgtttgttttggagtccccgtgaccagctgaatgcctgtacacaggctctcagtagctgccacttgttctatgagagcaaaggcctccccttcctgggtgcagagggctccccagcttgaggcgagctcaaggcttagccacccaagaaggcttctctgtcctggagacccaaaacgtaacagttccaggcatgtcacccctcaagagttgtgaatattctggaggcctcaaccatggacaaacctccatgtcctggatggcttctaaatttggtgcagatgtggagggacctcttcttcacccagttcgcctgccctgggggacagggttgctgtgacctctagctctccaccttctccctctgggcttctcccccaggggagggcactttccactcagcttgagatttgggtaagagggaagggaaacttatgtgtcggacaacatccttctaaggatgacaaggatttaggtaggaatgtgtctgcaggtgacacagtggccctccatgcaggagctggatcatggtcagcatgacctgtgactggtgatggtccgttccatgtgtgttcatggctgttatactgagtagcagtcacatgccaggcaacattacatacgttacagcagtatgcatgatgcattctgaaaacatgacatcctttattttatccccagagaggaaaagatcagactgacctcatcagtttatgaggaaggggattagcctgactgctcacctatcctctttaactctaagaagctagtattcccacacataccctaccagtggcaagtacccggggtgggggtctgatctaaccattcttcccaaaatagcctctgtaagtcacgttcagaagtctgaaattgaacatgagatgtgctgtcgttgcaaaaacaaccacagcaaacaacagtgcactgctgcccattgcgggtctgcagagaatgatggcttggggactccagccagggcccagatggggctgatgtgaaagtcagccatggaatgacttcaggagacctcattcctgatcttcatgattgcatagctttgacctctccaggccacatcatgtgcactgaaacatgagcccttgagattaagaggcctaatcctgtacggtcagtgtgtcgatggctggatgttcttgccccttcttccagcatgtgaaaggcttccctggcatggattccctaagggctcagttgcccggaaacacaagaagggtctcagtttgctcacccagtgcatggaggcgactgtgagtctgcagagacgtctctcattcctgcaccccctttccaccccctgctgtgttgggctggggcttgtccgccattcctctggcagacctgctgtgatttgggaaagcagaaatatgattgtctgctcctagaggccatgctcctgggcacagccaacccacccagagggtctcaaggttgatgaaatgctgtgagtaggttgcccctgattttgaagggttgattctcacctccacttcttcgtgggcatcttagagccactgcctgatgtgaaggaccggaggaggcagggagagggcatagggctaccctgcaggagccatccgagatgtcctgtcatcacctacagcaatggaggaggtggaggaggaggacgaaacaggcatcagaccgacacgcctgggtctgactcggtccacgtacctgcaatctgagagcaacggaactcttggcacagagccttggtctgggactgcatgtcagcttgccatcagagaaggaaacttccacagtcgatgggtgcagttcattacctgcagggaaaactaggtaccctgtgaggtgcatgaccacccagatggcacctgagggacctgggagtcctatccaggagcccagagaaagacttagggagatggggggttggcctgcaacagggaaagggaagcccaggggaatcgtggccagcggttttcatcctcccctgctgaggtgcagaccagggtccctggatctggtggttgacactggtcatgtgagacgtgctctctgtcatggcagggatgacctcgcagaccttgctgtgatcaggagtgaccccctcatgaccccgctgccatttgtgcgtgtggtcaaaaggccaccaaaccatcctcaataacaacagtccccacattctgggacacaggaaaaggactgctgaccaaaccatgccaacacaagacaggggcaccttccattccaaattcacagaacaggctggtgctgcactcagcctgcaatgaactggatcagcgtgagttcaagacaataagactcggtaaaataagtccctgccaggcttggaacgaaggcctggatcagcgaaatcaccgggtactgcccccaagaggtgtctcagaggccagccgcccagcctcctttgacagtgcccagccttgtggtcagcctggccccatggtcaccccttccaggcatggcggcaccgtcctcaggatattacagacagatgcgaccaagaatatgagagtgagcctgagaaccagtggaggggtgagtactcttcatccccacccctgccgcctgcacctctagagagggcacagctgggaccccaagcaggtggggaaatggaggagatgcaagtgggaagagcagagaattttattgagagagtctctggatgacatagaccctggcgggcaaaggtcggagacgtctgggccgctgcagggccggttgcagtggagggaaggagctgcaggccctggtggtggcagcacatccccaccggtaccggcattgtctaggctgggtttcctggaggcaggccctgagatggggaggtttgtggggagtgctctcaggacacacctgcgctgtggctgaagggaagcctgtctgatcctcggggctctggagctgagacagccctgcggagtttccccattggaagtgagccagcgctggcttcaggctgccctttgaaggggcagtcatgggtgatgctgcaccctgagggagattcccagtgcagccaccacagtgagtgatcagccactcatcgcccttcagaggggacccaggctgggcatccctggaccctgtccagtggtggggcttcagcctcagaatgcagcagaaacacaggcaaacctcatttcatcgcacttcactttgttgtgcctcacagatactgcattttttttacaaattgaagcttcggggcaacccagcatccaccaagtctagtggtgccattttccaacagcatgtgctcacttcgagtctctgtgtcacatttcggtaattcttataatatttcaaactttttcattatatctttatggtgatgtgatcagtgatttttggcgttactgttatggagttgttttgggcaccatggaccatgcccacataagacagcgaacttactcgataagtgatgtgtatgttctgacggctccacggacccaccgtttcccccatctctctttctctccccaggcctaccttttcccttagacacaacaatactgaaatcaggccttttagtaacgctaagtgacctctaagtggtcaagtgaaagctagagtcgaacatctctcactttaagtcaaaagttagaaatgattaagcttggcgaggaagtcatgtcaaaagctgagataggctgaaacttgtgccaaacagttatctaagttgtcaatgaaaagaaaagttattgaaggaaattaaaagtgctactccagggaacacacgaattataagaaagtgaaacagcctaattgctgatacggagaatgtttgagtggcctggatagaagatcaaaccaactgcaacattcccttaagccaaagcctaatccaaagcaaggccctaactctcttcaactccgtgaatgctgagagaggtgaggaagctaaaggaggaaagtttgaagctagcagaggttggttcgtgaggtttaaagaaagaagccatctctgcaacataaaagtacaaggtaaagcagcaagtgctgatggaaaagctgtagcaagttatccagaagatctagctaaaatcactgatgaaggtggcgacactaaacaacagattttcagtgtagacaaaacagccctatattggacaatgatgccatctaggactttcatagctagagaggagatatcaaggcctggcttcaaagctttaaaggacaggcagactctcttgttaggggctaatgcagctggtgactctaagtgaagccagtgttcatttgccattccgagaaccctagggctcttaagaattatgctaaatctactctgcctgtgctgtgtaaatgggacaaccacgcctgcatgatagcacacgtgtttacagcatggtttcctgaatattgtaagtccattgtcaagacctactgctcagaaaaaaaagattccttttaaaatattactgctcattgccagtgtacttggttattcaagagctctgatggagatgtacaaggagatgaatgttgttttcatgcctgctgacacagcatccattcttcagctcatggatcgaggatagtttagattgtcaagtgttcttattttaaaagtacatctttttctttctttctttctttcttttttttcttgagatggagtttcactctgtcgtccaggctggagtgcagtggcatgatcttggctcactgcaacctccgcctcctgggttcaagccattctcctgcctcagccttcccggtagctgggattacaggcgcatgccaccacgcccagctaatttttgtatattgtatatttttttagtagagacaggttttcgccatgttggccaggctggtgtctaactcctgacctcaagtgatccgtccgccttggcctcccaaagcgctgggattacaatcgtgagccactgcgcccggccaagcagtacatttcaaaggttatagctgccatagatggtgattcctctcatggatctgggcaaagtaaattgaaaaccttttggaaaggattcaccattctagggccattatgaacatttgtgattcatgggaggaggtcaaaatatcaacattaacaggagtgttgaagaaggttcttccaatcctcatggatgactttgagtggttggttcaagacttcagtgtaggaagtcaccgcagatgtggtagaaacagcaagagaactagaattagaaattgaacctgaagatgtaactgaattgctgcaatcttatgagaaaacttgaacagatgaggagttgctccttctagatgggcaagaaagtagtttcttgagataaaaatctcctcctggtgaagatggtgggaacatcattgaaatgacaacaaagagtttagaatagcacataaacagttgatgaagcagcagcagggtttaagaggattgcctccaattttgaaagaaattctactgtgggtaaaatgctgtcaaacagcatcaaatgctatagagaaatctatcatgaaagaaagagtcaatgtagcaaacctcattgctgtcttattttaagaagttgccacagccacccccacctttagccaccaccaccctgagtagtcagcaactattcacatcaagacaagaccctctaccagcaaataaattataactccctgaaggctcagatgatcattaacattttagggcaataaaatatatatatatatatttttttttgagacgagtctcgctctgtcacctaggctggagtgcagtggcatgatctcagctcactggaaccttcgcctcctgggttcaagcgattctctggccctagcctccctagtagctggggttgcaggtgcctgccaccacactgggctaattttcgtctttttagtagagacggggtttcaccattttgtcccagctggtctcaaactcctgacctcaggtgatccacctgcctcaggctaccaaagtgctgggattacaggcgtgagtcaccgtgcctggacaaagaaaatatttcttaattaaggtacttacatttttttagacataatgctatcgcatacttaatacgctactgtatagtataaatataatttttacatatattggtaaaccaaaaattcgggtgacagtttattgcaatatttgctctattggggcagtctggaaccaaacccacgagtatcccacaggtatgcctgtacctggagggctgttgaaacacagattgctgggccttacaccaggagctccagggtgaggccccagaatctctaacaagttccaggtgaggccagtaccactggcccaggttcacacttcgggagtccctgcacactagccccacacacaagtgtcaaaggtgctcagttgggaaagacatcagctcctaagctggcctcacagccgtgccaccccagctccttccttccatgaactctgtgacacttggttctacctgggagaaccccatctcaacccgcgtaactgcctgtgggatcccaggaaatcagaaggccccagggagaaccgagcagtttctgctggctgggctgagccagaccatgatgtcagccctcagggaagaggcgaaggcagcagtgctcccggagctggccatcctgaggccatacctgcagctccccaggtgctcgcgcacgctcctctgagcatctgcactcatcctcgccctgcctgcagctcctggtcgcctctgagctcctgagcctgcttcagcccttccacaggacttacccagccctccccagccccctggcctccagtgcagcccctgacagcactcctgctgtgggtcttccctgcagagtgggtgctgcacctagatggaagaggtgaggaggaagcacacgcctccctaattcgagccagcgtggccctgggagaaaagtagaagtgggacttctggtaggagaactgggaatcatttacttattttagaagacgtatgagcaagccaccatctagaggagaaaggggatgaaattagcgaaggcactaaaatactttggtttactctgattagagcggaagagaaatctgcagacaattagcagcaagtaaagatcttgctatagaaataaggaagtagtatgggtaagcgaaggctgtgctgttagtttcaacaggctgcacgtgaaagcagacacatgccatgcccagctgggtcagccgagtcggcccagccgccagcctatcttgtctgtgcaccgtcccgggtgtggtgagcccctggccccatgcctgactgcacacctgccgcggccacttctgcctggaggaggctgtacttgtcctcagcaacctgccctcaagaggcgctttttctcattggcatgaaagccctatacacgctaccaggtggtggtgaggaaggctctctgatcctaaaatcccatgattgccttaaataagtatttgaagtaccaacctgtgagaatccgcagaggtgatgtctgagcatgcagggtggccttggctggtctcgagtgttatggagatgccctgagcactccgcagggcctgtgttgagctgccaaggtgttttcaagcaaatggaaggtgagagttgggctcaggagccaggaggttgtgagccctgctacctgcaggtgctgcccggttctccctgccatgccagacccaggtgcatgtgtctacgaagactggctcgccactgagtgcaggggacgccatccagctcagccaggagactctgaactggcagtcctgacaggactcaactcacagacgttggtgagaaacagggtaacaggcgatgccactgtggctgcagggggcagcggcagagaccctgagaggtgggagggaggcaggttgggaagggccggtctcggcacaaattgctcttcagtgtggtccctccaaggcctcctcttgagtacctcagagaggacagcagatgcagttgacccccacccgggccaaggcccacccaacacgagccgcatgccagaaaacagacccagcacatccatctgcttttggtgtcccctacgaggcacccagaggaaaaaaagtaggcagagaagagatttttcaaagtgaagctaggcttatttacattccagttcccccagcaacctacacctagaggccgaacttaaaatagagatcagagtgaaggattactcatcaacagaacgaacttaaaatttaagatgaagaggccaagtgcactagtgccctggtgcacgtcagggcagcatctccctacgcgttggccacaccgggcctgtgcttggagtgaggagccaacataccccattcaggaccccagcctccccgggccacacctctgtgcaactgcagctctcatcttgcccaagccctgccccagctgtgccccaggccgcgctgacagctccagcagcccagccctggccctacccctgaacatgcgtgaccatggacagaagctccatcccctcgagcttttgtgtccgcagctgtgaaacatgtgcaagaaggccacagacagccctggggaggaagcacgttgcacagggccacccgagcagaggtagccctgctaggggttccatgctcccaggccaccaagctccacgctgtgcagggagcctgcagtagcctggagggagaagtggcccagccccagtcagcgggtgtagccgcagccaatccacggaacaaggcctccacagagcacagcccaccccacacaggccactgagcccctagctctgcaccttgcctaccagcccaggagcaggagggagaggagtccgtgagctgtggtcagcagctagggcgtgttctgagcctgccttggcagctgatgagccccccactccagaggaaaggcagccccggaccccagaaccaactaaaaggagctgttggtgcggcctgagttgcatactgttgcccatggccaggagccaacccggctgcgcattctgcatgtggccactgaagcaaactgttttgacaccataaagcaacagatgaggctaacttaagcaggatttacactcaattgtatttctctgagagcaggcacatcaatttgtgcgtcattgttactgattcacaagccttccacggatccaagtcctccctgcactcttcctctcctcttctgccttcctttgcctcagcccaggctgtgtggaagccaccctcctctcctctccccttctctttcttcctctgtcctctccccgtcctctcccatcctctccccatctcctcctcctccctcctcctccctccatctctctcatcccctttctttcacctctccccgttctcctctcctcccctccagcttccctgcacaatacacaggtacgtgttggctgcagttgtttgtcattttcactggacttttcccttagtggtatttcctctatggtgatgggaacagaatcacaccctggtttctctccatttgtcacctagacatagcattgaaactgtgaacgtggtggggtggcggggtcctctcctgatgattttgtgtatcctcctgaagcccagagttggtcctaatttcactgtcagtgttcaccatttcaaacagggaaagaaacaaagatgccagccacagttggagcccacagcatgtccctaggaggagggcatgagggacacctatcaacaaaggaaatagccaaggtcattgaatgagggcagagggccttgctatgtaggattaggatgttcgaaaaggggggcagatttcatattaaggccaagaaacttttaatctctacaaggttctcctgctattccagaatattccacactggttcttttttcctgcttgagccctcgtgagctgcattctgtttctgttttcacttctaagtggggttcctccagcatcaggagggtgcaatggtggggtctatgagcttccctcatatccccagagatgcactgtgtgcacaagccgctggatagggtcagcatccccacccagcagcctgcactggtgtgaggtccaccagatcactcttcattaacattcatctttggtctcttagtgaactgaggcctccaccagcttccgtggctgaatcttgtgagcaaataaaataatctggtatgttctctccctccgttcaaaaccaaccttccccaaatcccaaaagtagcagagcacttttgtaagtattatccaatctttacaaggaaaagatataggtatagttaagtattttatgagagtagcttggcccatgggctgagttagaggcacagcatctaaaccctaagctgggattttcaccactaaatttgctctttccttatttgcaaataagacttaaaattaaggctggtgtaatcccagcactttgggaggctgaaatgggaggattgcttgagactaggagctcaagaccagtctgggcaacatagtgggaccccatctttacaaaaaataaaaaacttagccagcatggcggtgcacacctgtggtcccagctgcttaggaggctgaggtgggaggatcacttgagcccaggccattgaggctgcagtgagctatgcttgtaccactgcactccagcctgggtgacagggtgagatgctgtttcaaaaaaaaaaaggtcaagtaattaaccatagcacaattactgcaaggaagtgtgcaaccacagttttctaacttaaccacctttcccttaaaaagggcctctgaggtctcttccacctctggttgattggataagccaggcaggaaaaccaggccaggttatattaagtgaggaaaacccagcccaagaatagcttagctcaccctcagttttccctaaggtttcccttgctcagagcatcagactttagaagaggaaaacactggaaatccaaagagctggccctgggatgcagttcagagagtccttgagggctttggggtcactgggccttagggagctgccttcctatctgtcagatgggcaggtggaatcctcctaaggctgtgggtgacaggcacacccctcccctgcaggcagctccccgaaggctccctgcctcgtgggtttgttatgaggagtgagctggggagggtgtgtgaggcctctgtaaactgcagagcccccatagactctagtgggtctttttaggttgggttcctccaaagacaacctccccccaggaatgccggccggtcccctatccccaggagggctcccactgacactggccccatgctttgcccgcaggtacctggcgctctacgcctacaagccccagaagagtgacgagctggagctgcacaagggagagatgtaccgggtcctcgagaagtgtcaggatggctggttcaagggggcgtctctgaggaccggggtctctggggtgttccccggaaactacgtgacacccgtttccaggtgagggcatggtggtggcagcctgggcaaggagagggcaagggcctgcacgccttaccgctgttgttactgctggaggctactctgtcagccgggcccagaaggcagcaaggccaccagtgcccagggttcagcccccactggcgtccccaggcccacatttcaccttctgagctgggtttgcactcaactccttggctgtcctcagcagacattggccaccaaggggagaagaatgggatcaggaggagcagggacaggaaagtcaccagaatgaggtctcaagtgtgaatgtgtgtttgtgtgaggacagtgtgtgcacatatatacagtgtgttcagcgtgtatgctatgcgtgtgcagtgtgtgcacgcttctgtgtgcttgtgtgcatggtatttgtgcatgtgtgcagagtatgtgcagtgtgcgtgcctgtgcacgtgcgtatgcatactgtaagcacaaggtgtgtgcgtgtgtgcataatgtaggtacagcatgtgtgtatgcagtgtgtatgcatgtgtgtgcagtgtgtgtcatcatatatagacgtgtgatatgtaaaacactatatacatatatgcaaaggaaaaatgatatcttcccaaaggtcaacgattgttgagtggtcgcattgtggtaatatatttttttctttgtgttgtcagtgtttaataagttctcagttctactacttttatcaaatagaatatgtaattttagagtcactgaagagacaagggggttgtctgggaatttttcgctgagatgaggatccacagcttggtgatatcagtcagcctcactcacagaagcccctcgtgggcacggccctgtgttgacactgcaggacacacacacagaagcgaaagacgtggccttgggtttctcctgtctttggaacaaggctacagtggaaataaataacctgtagaccctgcattgattgctgggctgattgctacttgcagagtggtctcgggacacatgcggtgttgacttgagcagctctagttcgcaaggcaatcttcagccagggcctctctcgaggtgcccagaagcgggggctaagggatgatggagttgcccaaagcctgaaaggtctgcaggcacaaggctgaaggggcagttagagatccttcgctcaggtgatgctcagcagggaaaagcttgagaagcaaactgcagaggggcttcaggaaatgcaccccctcaaacccagccacctggtcagaggggtggctacttagagggtgagctgcccacagcctcctgcggcttcttcagtggtgtggggtgacttgcccagtgtgcgcagccccgaagaaggtctctggtctggatttcccatgccagtaggaacaggttggctctctcagcctgcaaccggcctgtgcttgaagcccctggcctggagttgggctcacctgtcgtgtcatcagatggctcttccaggaaagcacaggtcacccctctaggttaggggactccctgaccagctggcaccctccaggaaggcgcagcctgagatggcgggtgtccacacctctgggctcgcccgccctgctgggggacatcactctgtcacacgccctactgttatatgaggaggcaggttcttcctccatgcagcaggttagagcagcagcttctgagggaggccatcggcttcccagtttccagtttctctcctctgattcttcctttatctttacctgagaacttccgcagaccttcagagatgtaaagcctgcggttgaaatccagcttccttgcgtagcattgggacatcgcctggccgggcaactcctgacgtgtgtcagtcagtgtcaccacagggagctctcttaggcgcctcccacccccacaacactggactgccttccaccctcttcctgcttctgagttaaatccctgaatatccttcaagagctgggtcctaagtccacttgctatatgaagccttgcctggaggccctcatccttgcctgtgctgtagtcgggatggacagctctgcccacggtgtcatcccaagcagcccactggcaagttctacaggcattcaggatcccccctcacaggccagtccctgggccgcaatagccatctccagccttgtttacctggctccttgcataccatgttcatatacgaggtgctcaataaatgcagatcgaatcaataaaagaaatctagttgttctgatcaaaatgtctcctcaagaactgtcttctcctgctgccagggagtttgttatgggaagatcctccagctcctgacactggagcacttagagtggcccggtcccctccctctacctctgctgtgcacctcatggttgctcactctcctcaagccctcttggtctgtgttttccaaagaatggcagagccaggaataaacattaaggaaaagccactccaaatctagccccggtaactgcagtgtcaggaggtcattgagtgtcctctccggttccttagagaaggaactgcgcccgggtcggctgcccccaggtcagtatgttgaaggccatgggtccctcagtccaatccatagctcagcacaaaacaggaaatctggcctcggtctttatccccagaagtggaagacacctgtccccctccaaagctgtgcccccaggacttatactttcttgatccctactgggttcaggacaattgccaaagccacacagcagaaggcttatctggcagtgattggagggtaggcgaaggcctactccttcctgcatagacctggatccaccacctgtgtttgcccccatcgtgctaggaggccctgaagtgctggtgggctctcggggctgggagtatagtgctcagagctgagcattgtgagtccatttaaaaacctggtgtgggagcaggtatgtggctcttcccgtgagggcacgcactaaggaagtaggactagccaagggtatctctgccatcctgccatgagggcagagggaaagggttttctgctgtcatgagaggcagatgtgtgtctgtatctgttgtgttcagacttgtcaatatcaccttgcaaattagtgactcatcatttgtgagcccactttatttagtttttaaaaatgatttcctcggggaaaagtgagctcaacagatgatagaaaatgggatttttaaattcatggttttggctgacctgctaacaagcttgattgctgggtgaagttcagcacagctctgagggctggggaaggaggacaccacccagggtcccctagcaggtgagtccttttccaagaggcccctctcctctcagctgctgtgcagaaaccctcactctgtgttgccgggagcttccctgctagaggtcgtgcccagtgataccagccacagggagatggctggaccaggcacaggagacggggcaggcagcctgttctcccacctgtggcttcttggtgtgtcttgaaataagatcctgaagggacagaaacaggaatttacccagctcttggacaaatggaagacatttaattcccctgaaactgaatccacagaagcttccaaacccctaactctgccatatttcacatcgctgcctccaggacatggattaattgcaaatacacagagggaaagcgtgaaaagccccatttccagagtgttcctcttgtgtgagctgatgtcatctggaaacttcggagtgaaagggcatctatttctggtatggaactgcaagctcccagacattctcagaaggatgtcgtgctgtgtgtgccctttcccagcagccagcagatgcgaggtggcagtcgtgcccagagggggcccgcgtccttgccatcctttccccaatgtgctggatgtgtcaaggcctcgcgggacatgactgagtcatctgttctttctggatgtatctggagacacacagctgtttgtaagaacaaattaaggcagtagctgtggtataaaagatttcgttcagctcattcctctgtttctcagggcggctttgctatctcttaaatatttcacactgacagtttgcaccccatgaaggttttgtaaacagggcccttctgcccagtgacgggcattgttttaggacctcgtccccagatcagttggccttcatctcttaaagccagcaggtcagagcgaggctctgccagaggcccacatggcacgaatgcctctgagcctctcatcagaattccttctgctttctctccacagggtgcctgcaggaggggcagggccgccccggaataatgtagtcggagggtctccactggccaaagggataaccacaaccatgcacccaggcagtgggagtctgagcagcctggccactgccaccaggcccgccctgcccatcaccactccccaggcccacgcccagcaccccacagcctcgcccccaacaggcagctgtctacggcactcagcccagccaacggccagccaagcccggagcaccatttcaacaggtaccttcacaggggcctcaccctgcagggcatcaacaagggggcttcctgggacatgcttgtgagacacatcttggcccaaggctccagcagtgcatgtgtggctggtggcagcttcatggcagctggagaaacttaaggaaaaccggtttggccccagaatgttgtgagatgaaaagaaattatggggtgggccttaaaggcataaagaaggtaagcacatcttgtcatgctcgtgaacgtctgatctccaggaagttcacttgccttatcatgttacccatcctggcagctgaagtaaatttacaaatatttacacatttcattgtggcaagagggcctcatagactaataagattaacaccggcactttcaaatgcctcccccatgaatgattgtgggccggccacgtgggtcttccatctgccgggccctgcagggcttcccagctaggcggcatctcacaggacagggctggggtgagactcgggcccaggctcttccctttctgaagtgctctgaggcaggaggaatgacagctgttgatccttcgccttcatggcagctggagaaacttaaggaaaaccggtttggccccaggatgttgtgagatgaaaagaaattatggggtgggccttaaaggcataaagaaggtaagcacatcttggttggtggcttagtgttgagctaataagaactgctgatgctggattcgcaggatgatctgggagcccatgccacggcgtcttccaccacggtggagccagtgatgctgacatgatgccaagtaccccaggacaagaggggataacacagaatctctcttcccaccccaaccctgtcctctcagaaatcatctgtttttctcaaagtgaggcttaaagggcaaaaataatgtaaattcatggaagcaataaaatatactatttcttagactaacgaacacgatgacccattagaagtgtccagaaagcagcttctcaagtgtggaaagaggagacaacacttaggtcagcagaggccatatttccttccttatcttagctgatgggacaaggggtgggaggtaagtgtctgtcatccacttgcccacccaagtgggtgcagggtagacttcaggtatccagtgcccagcatcgtcactgggtgcaggtggactttgagtgcctggtgtctggcaccatcagcaggtatagggtgaactttgggtgcccaatgtctggcaccatcagtgggtgcaggtggacttcaggtgcccagtgttcagccttgtgctggtggtgtacctgtcaagcagtgggtaatttagcactaggaaagcttcatgggtggtctgaggactaccctggtgtcagagccttcaagacctactctgccatctcagattctgtaagtctctactagtatcttttttacttaaatcagctaagaatgattcttggttttcacacccctggctccagggccctgggaaagaatctgcagcaatattacctggtgcccaagcccaccctgcaacccatgaccttctgatcagccgtccttcagcatggtttacgtggatctgtgttttctggtagcctctagctggggatacagtcattgcagttggcaagtgatctggtgatctgaagttgtgctccctgactggtcagaggcagccaatatgctgatctgtttggccactggagcacccaggcaggaccaggggagcaaaagtcccaggccaggtcccttctggttataaacatctcatccaatcagcccggtgttctgtacaaatgtttccacatgcaccagcactagaaagggtgagtggccccactcatcacggtgagtcagcatcccagtgcagtggccctgggttgtctgcccagaatagccagtataatggtctttccacaccaagccttgctagaaacgttcccaattcaaagaagaaatggagccctgccagtcacttctccctctgtggaataacaagcaggatcaaaagaaattggcaaggctgtggggcagtgcaacattgtgtctcagtcctccatcaccatagtaaccatgagggtgccacgagcattctcttccatcagtttaatgttacacacggggagagtgaggcacgggatggttaaacggctccccagtgcatcccagcccagcacttgtccccacgctattgctgtcacagccaggttaaagaatgactcctactgagccatatcagtaaattaaatgccactgagttcctgcggcattttccacttcattctgcatttagagagagaaaaaacactgttgacagtccaagtaatggattgttccctgcagtaattgcccatttcagcagaccccaaccccgatgggtgggaggcatttcatcaatgttctcatctcgagccaaagtcaggcagtttgacaaaggcttaattgcattggccatagcatccaatatgatttgttctacttgattaatgtaactcctttcccaaaggcagagcaccccctgtaaagtgccagtgttccttgcacactcctgtctgtgcttagcaggagtaagagcccagcatagccatgaattcatcagcaaaaaagcaccgagaaggagctagatacaggcaaggcaccctgcaggggtctggaaacagaggaaaaccagacaagccccatttccaccccggttagagagaatgactagaaaacaaagttctgtggtgggtttgctaaagggctgcaaaagaggcctgcttaggtattaagagagtgtggaggagggaattcattccgactggggaggaaaataggagggggattgggagtagggcatatggaaagttttcaagaggaggtgataatgccttgaatcttaaaggacaaataggaagtgtctgagcagacaaaagagaaaggaggttcagagcagaggaaccagcatgagcaatggcctggcaatgaggaatagcataactcttgttttggggaactttatttagttgtgacatgactgaagcaaagctatggaagaaggagaagtccagtgtgtagatgacagttccctgcagaggcatactgtcctttaaatctgaaaggtgggtagagctcagcatgcagcagtaggagagtgtgggaagcactcaggaaggggaagcatggggagctcttgggccgccgaggccaggggcccatggacgctggaatacggatagggtgcgggagcaaagaaagacccgcagtgaagccgaaaagctaagcagagcagagcatggaggttcttctagaccacgtaaggaatttagatgtttatcctaagggggcacatcaaagggtgttgaataatagacatagtcatatttttgtatttaaaagattgagctagacttctgcttatggccaatctgaagtgatgaggacaggaattactctcccacatgaaacaaatttaaaaagccaagtatataaaacaacagttttcaagacaccagacaaccaaggactgattcatgagagaagttgcaggcagtggcaaaaggaggcaggtaaccaggtggaggagccccgaggatgtggagatcagagtttgtgtgacagagagggcttgagtttccagggcagtgaccagagaggagagaacagcacagagaggctgcagagcacgccctgagatcttcaggtgacaactcatctgcatatgaacatgagaaacgtacccaaagccaggaaaagaatcaaagaaagaaaggattagtgctaacagtgcccagaatacacaccagctggaaatagtgcctgttcccaccagccagacggaaaaattgcagaaatcaccaggcattgagtaatctacacaggaccttgcctctgtagtggtcagactgagcactgttccaatttcacccaacagagctcaaaaacaacactcaagagtcaaactatttctgattaatttatctttgtcccagaacaaagcttaagaatatttataggaatacaaaaaaaaaaaaaattccagctctcaacaacataaaaatcacaatgtctgatgtccaataaaaaattatgaggcatgcaaaggagcaggaaaatatgacttataatgaagggatcagtcaatcaatcaaaactgaccccaaattgacatagatgttgcaaagacatttaaaaatgatattacagttgcctttcacatactcagaaagttaagtagagacataatagacccaaatcacacttctagaaataaaaactacagtgtgtgagatcaagaatatactagatggaattaatggcagattaaacattgctgaagaaaaaatatttgtaaacttgaagatatagtaatagaagccgtggaaagtggaacacagagataaaagacaattttgaaaaatgaatggaatccgtgagcaatgggacaactttaagtggcctaatatacgtgtaattggaggtctccaatgtagaggagagaggtaggacagaaaaatgatttgaagaaataatgaccaaaattgttccaaatttgatgaaaaccacaaacacagtttcaaagacagttggtgaacaccaagcacaagaaacatgaagaaaactgtaacaaggcaaatcacaatcaaactgttcaaaatctctcataaagaaaacactgaaaacagccagaggacaaaaagatacattacatgaaatagaaaaaaagataagggtaaggatgatgtcaagaacagttcaagtgagatgacagaataaccaaaaaacatactgaaagaaatatagctgtcaatctagtactctactcccagcaaaaatatctttcaaaaaaaaagcaaaataaagaattattcagaaatagtaaaactaaaagattttgtctctaataaatccacactattggccaggcacagtggctcacgcctgtaatcccagcactttgggaggctgagacgggtggatcacgaggtcaggagattgagaccatcctggctaacacagtgaaaccccgtctctactaaaaacacaaaaaattagccaggcgtgttggcgggcgcctgtagtcccagctgctcaggaggctgaggcaggtgaatgacatgaacctgggaggcagagcttacagtgagccgagatcgtgccactgcactccagcctgggcaacggagtgagactccacctcaaaaaaaaaaaaaaaagaaaaaatccacactattagaaaggtaaaaatgaaattatttagaaagaaggcagatgataccagatgaaaatgaagatctatacaaaggaatgaaaagcactggaaatggtaactacatagataaatatataagatgttttcttattatttgaatatctttaaaatataattgactgtttaaacaaaagtgaaagcaatctagtttgggatttaaaactcaaaagcaaaatgtacaataaacaaaaacacaaagtttgggaagggagaagtggaagtttggtatactactgtaacattcttatactatgaatctttatgttatgaaatcatttgtaaatgactataataaaataaagatgtaagcagtcactaaatatgaaacaaaaagttacagcaaataagctaaaagggaataaaaaggaatcatgaaaacatccaaaagaaagcattaacagaagggaaaagaaacaatacatgggtcaaagagaaaacatatagtaggatggtaggtttaaacctaatcatgtaagtaatcacactaaatgtaaatggcctaaataaccctaaatataattcagagattgtcacatattactaaaaacaaacaaaaaaccaacgatatgctgtgagtaagaaacatactttaatacttcaagtctaaagacataaataagctaaaagtgaagggatggaacaagttatacacattctcattattcatggtagttacattctatgaagttatcatgaacactgaatttgtgaatactgaactattgcttctaggtgaaattgtgtgtggcatgcgtgcatgggtgtgtacacatatctcacataaattatcatcttattctagtagattctattttatttatttgacaaaagagaaaatgaggttcagaaggattaagtggctgacctgaggctgccctattaacaggtgccagagctgggattcaaatactgtccaactggcctcagagccaaaactttctgcattgtactgtgttgccccctatcggctctatcctcctgtcatctctgtgtgacgctgaaacaaaaatcgccttgttcaacctcagctgggaatatgagtgtcaggcaactcaaatttttgccattccatgaatgtctgaaaataactgaaagcaccacagataatgacttgggggttacaaatcgtttttcactagtagaagaatttgcaaatacagaatctgccaataatgagaatagattatatgatgctaatattaatcaaaagaaagctggagtggttatcttaatcagatagagcagaatttataaaaattattagagataaaaaggcaatttcgtaacaataaaggggtcagttcatttagaggacataacagttctaaatatttatacaccaagtaacagaacttcaaaatacataagcaatatggataaaggtacaaggagaaataaacaaatctacaattatggtcagagactttcatgtctcaataattgatagaacagttagatataaaatggtaaaaatttaaaacattagaacaacagtataatcaacttgacttagttgacgtttgtgaaacattctacccaacaacagcaaaatgcaccttcttttcaagtgcacacagaacatttactgagatagattatgtactgggccatgatatttttaagtttcagcacatttaaagggattcaagtcatggaaactacattccctgaccacagtggcattgaattagaattcattaatacaaataataacaaatatttgatatactcaaatatttgaaaactaaacagtttacttcaaaataacccatatattaaagaacaaatcaaaagggatattataacgcattttgagctgaatgaaatgaaaaagaacagtgaacttgggaagctaacactgatttagagacttcttaaaaaatacagtaattaagtttatgtgatgttgttgtaaagatgtttgtttttaatatttaaaaagtcaactctgtgggtctatataaaatggaacacacaatagccaagtgctgaagcactggcctactggctgtaggataaaaagcaggccttgttgggtgactttcaactcctgcaggagaatatggacaggaagcccctgtgagaatcaggggaccagagctaggtgtgccagttctaaaaattccatcattttccaggggatgggccatactaagcctccacctggggtgtgagagaaagaagagagagccccaaccctggtcatggtgctgagtttgaggatggctctggcctgaggactaggactagctcagcaccctctctgcaggaccagaactccaagaagcccattaaacctagttctaagggagggtcctagaggccaagcagcactaacaacagaactgccagacccagaaaagtagacaaagagccgcaagctcagggtgagctggcacattaagatttcaaaacacaaaagggaaactcacacataagttagccaataaactcaagagataggaggaaaataagggagaaatctgagagcatctttgaaatcagtatgtttaagatctaagaggaaaagaaggaataacatatacacacacaaaaaagaaaaacaggaagctatgaaaaaataggtggatggctatgaatcagaaacaactggatatgaaaaagaaccaatttgaaattttggagaggaaaaatatatatttaaatacaaaacctctgtaggtagcataaactctagacacagttgaaagtggaattagtgaaattggaaagccatacagaggaatttatccagaatacagagcagagatgaaaaatgtgaaagagatgtataaacatggaggatagattgaggagctccaaactacttctaacaggattttcataactagaaaatagaagagatgggacagagagaagattcaaaggagtagtccctgagaattctccaaaattgaagaggggctcaagtcctcacacagaaagcacaaagagtgctgagtaggaaaaataaccaaaaatccaagcctaaacatgctgaacttaaacttaaagcatcaaaggataaggaaaatactacaaaacctgccagagggcagatacagattacttacatagaaatgaataaaaatataagaaagagccagtgtacacactatttcaaaaatattaagtgtaaagaaaaatgggaaaaggaggtactagctaaaagaggacaaggtatagaaggaagattatttattaaatgggagagacaactggttaataaattatgggggaaagctaataaagaggctaaatatatgagagaagggatgagccagagaaggtatcaaggatgtgggtgaaggcgttgacctggtgggacccagagtccttgtgactggaagggaggggtgtggggaagtagagaggggggttggcttggagttgtgggagttccatttcatccctgaagtgggaagcgatacccctgaaaataaggaaaggacaaagctggtgatgcaatagatcatttattcattcccctatcatttataaagcacctacagatactagggacatagaatgaactgagtgagggctcacagtccttggaagctgcagcgggactgaaacacaccaaaagtttaaagaagagaggaaagggaaaagcagggaccatgggtggtgctttcctaagcagccttcatctgtcagcttgacttcaaagaagatgtgggctactttggcatcactaacgagtagtcccagccagctcggggttggggcacccggggtgggtgaaaataagggtaaatcctaccagagatgagcacactcttcaccagccagtgtcatgacctgagctgtgccttgctttctcacgctacagtttttcttctccagtggttccattctgtgaaatcggaagtgacatggctggggttcttttttcctcagagactcactcttttattcaaaaaatgtacagagcaccttctacatgccagggaccattgcgggcgttatcgtgaattaagcagccatgtccccacctcatggagctccgttgcacagtggggacaggcaatgaataatcagcctccagcgaacatgtaaattacacaactgtgaggagctaagagccttgggagcaaaggaaagctggagctagagcaggagcaggggaggctgaggctgcagggtcaggcagcaccgtgaaggtggtaggcaggtctctagaaggtggtatctgagccttccaggcacccgagggtcccaccttgcagctatgagggaggtgaggtctatgggcaggggtgctggcactgtgcctctgaggtgaccaggagccagtcctattggcagagtggccaggaggccagtgtggctgaggggagagtattaggaggtgaggttggagcttgctggaacacactccctctcttctttggtgcctgggatgagcaaagtagtgcggcaggcgaggggaagccggccaggaggtagaggccagccacgcacagcccaggggcacagaccctggtgcagtcccaacgccgagggccacagcgcttccctggcaggctgtcaccccccttccagggaccctggaccgagagaaggggagtcagacagctgaggggagagacgaataaatctcgaggagcggcctctgagtcagggtttccagggtgattaaatgacccgaggcccctggatctgcgtgattgcctgacctgctctccttgtaaatgtggagctgtgttgggttaggatcaaatgtttcaagtttccaacccagctgaagccctgaatatttaaaaaaaaaaaaaaaaaaaaagaaaagaaaaagaaaaagaaaacagaaaaaaaaaacccacataaatcagcctttctgtatttcacctcgtagaaacagcaggctgcctaagtcccggagaatctgggatcacataattagatctcaccagcgcttcacacacggctgtgtcagaagaaggcctgactcccagatggagagctttgtatgtctcacggtgctacttcccgtggcctccaaacgctgttaggattaacgagtgcatagttgggggctgagaagattgtttttattgcatgtattttctttcatgctctgaagccatgaatgccacaaagtctgctggtagaaaatgattacagtatgacataatttttctctgccttaagaatgcacagcagctggatgtgagctgcgtggtgctgcccgggccacttggtataaagcagtgtctgatgctcagcccaggtctccacttgggccagaacaacccaggacacaagtcaccattcccctggggccgttcattctctcccagcatttgtttcatccatatttattaaggagataattccctgaaattactaacacacatagtagcaggattactattaatgtggtgctgtgtttaaagggagctgtatcttttcatatgggagatttttgcaaatgttacaacttgcaatccctaacatctttaagaattgtttttgctggcagcaaggtggtggatccacagttgtaaggttccagttttgtaaacctggaagcccggtgcttcgacatgcaggcagagcagcaaatgcaggcagatggcagcagggtggtgggcggcttctcctccaggctgctgctgggagaaacgtctgctgctttcttcctgcaattgtccccagccaaggcagctctcacatgctcagccctcactcttgctgagtgacatacccagtgtggaaaccaaggaccagccaggccagttcgggatcaagagtaactagagtcaagcttggtcggcttgcatgcagtggtgcttaataattcaggggacatcttgaggcttcactgagatgctttcacaggctttatgtttatgagcattttacaaccatatttcaaaaccatattttcaaaatttttctgagtgcttcagctcatcacagcagagaaaattatttagagcaggagtccccagcctccaagccacagaccaattccggtccatggtctgttaggaactgggctgcacagcaggttgtgagtggtgggtgagcaaggaaaacttcatctgtatttacagcccctcctcaacgcttgcattaccacctgagctccaccacccatcacattagcagcggcattaggttctcataggagagcaaaccttactccacttacttgggatctaggttgcacgctccttatgagaatctaatggctgatgatctgtcactgtctcccatcatctctagatgggcctgtctagttgcaggaaaataagctcaggggtcctactgattctatgttatggtgagttgtatacttatttcactatatattacaatgtagtaataatagaaataaagtacataacaaatgtaatgcacttgaatcatcccgaaaccatcccctgcctcagtctgtggaaaaattgtcttccacaaaacgggtccttggtgccaaaatggttggggaccgctgagttaaaggacttcatagaactgggaatgtgcccatgttcatggcaaccttggcaaagctgttttagctccacctgaggaaaggggtgttttgagccgtggcagggccccctgatcccttgggctttggaagataggaatgcattttcagggtttcttggcctgtttctccatctgtgaagaggccaggtctgtctggagaaacttcagagagaggctgtgagtgctcgagaagggagcctgagtgtgcattgcagctgcctggcaggcatggcaagttgcaaactaacctttcaacctgctgtctctccaaccccgtctccagctgcccactctgcagcccaggctcaggaccggccaactgccaccgtgtcacccctgcgcacccagaactctccatcccgcctgcctgccaccagcctcaggccccactcggtggtgtccccgcagcacagccaccagcccccggtgcagatgtgcccacggccggccatccccctcacatcagcagcatcagccatcacacctcccaacgtcagtgccgcaaacctcaacggggaggctggaggggggcccatcggtgttctgtccacatccagccccaccaacacgggatgcaaactagacgagaagaaaagtgaaaaggtaagaggcccatcctggacgagccctgggctcgaggccagctgcttactgtaactttttggcactagatggcagtggcatttgtgcaattgaagctagaatgtgggctccaagtgcctgcccctagatgaaccaggcgtgtgacagagagggagccaaaccaccagagcagctggttggagaggaatcaggcaggccttgggtgctggcagggccatgcaagtccagctacatttctcatgcaaatcagaaaaaggtgtcccctcttgaaaatgccttagttccatctgttgtaaaatcattgtaatatactcattttgttagaacaggatatttattgccatgtgctgggatattgtaataataaatatacaaatctacgtgtgcagtgtgaacagcacccactcccttcaatatgtcatccttgtgcagtccacaacctgttcaaccatatgggacaggcctgtttcctgaggagcaatgagaaggaacaggagaatgctgacctgatggctggtgtgttttttagctattcttttagccatgaagtgctgatttcataaaagaaaatctgggccaggcgtggtggctcaagcctgtaatctcagcactttgggaggctgaggcgggcggatcacctgaggtcaggagtttgaaaccagcctggccaacatggcaaaaccccatctctactaaaaatacaaaaattagccaggcatggtggcgtgcgcctgtaatcccagctacctaggaggctgaggcaggagaatcactggaaaccggggggcagagcctgcagtgagccaagattgtgccactgcactccagcctgggcaacagagcaagactgcatctcaaaaaaaaaaaaagaaaaagaaagaaaatctgagtccaagaaacttgttccggttgccaccctgctagacgttagattaaccaggatgagaatccagacttctaaatcagtgctgtccagcagaaacataatgcaaacctcaaatctaattttaaattttctagtagccacatttttaaaaagtaaaattaattttaaagtaaatttaaaaggtgaaattcattttaacagcttattccattaaacccaatatccagaatattattgtttcaacatgtaacctatgttttaaaattgttgatgagatattttagtattttttttttacgtgaagtttttggaagcccatgtgaaatccaataagcaattctccagggctcagggcccatgcactgcctgaggctgtatccctagggcgttgggctgggtgctgggcaaggagccactctgtgtattggccttgctgcctgaacggtttagggattgttctctcttggcttgactgattctgcagatcttttgacatctttccatataaaattagtctttggatcaccctggacactagatggtgtgttccaggcaaggacagcctctctctctttctcgaggacattgccaaacccagcgctgactcggcgggctctctgcccatcaccctggaggcaggccctgctcccctgtcctcaacatgagccgggaacgctgcagacatgggccacaccaggttccgcagggcctcagcacctcctgtgttgttcagtccagagcaatggttgttcccgtgctgactggtgtggcagagccaatgcagctagcaaagctcaggtctgctccagcctaacagggcgcctggcatgaagggcaacagctgctctgtgttttgtgtgtctgtttgaagatcagttcagtcttgaatctgttcccttctaccctgcagcccttgttatgagatgtggctgggtctcatcaggagggagaggtgggattcacagtcctaccctctcacttaagcattcttccttcttctgagctgctcagaaacaaccaggggcagacttggaaagtgggggctgtaatagttccttaagcatttctagttctttgcccaagaattccctctctctagtttgtgaagcaaatgggactggcttcaataataccattgctgagtgggtttctatgacattacgtcctgtacgaatctacacggaggatgatgctgttccccatcacccacctaagtgtgaagctaatgaacaccagctgagtctgttcctagcctgcctgttagacactttgtaaatatttcgctttctcttaaggtttatgccctctaacagttgtgctatatcagcaaagaacagttgagtccagaagacaccccaacatccctcttgatgaaaggcgacatgcagggacgccctgccatgcaagctgcacatacagtggctcagcctcctcctcccctgatagctcccgagcctctgtgggcagcagaagtgcgtaggccacgcttggggctggacacatgctgtgggagcagtccacgctgcactccaggcaggaggggaagtggtttttgtgaggccctctgagcttatgtccagaggttcagcaaaccccagcagagaagcacattgccctcccacacattgtgtgtgcttttcattcccacctctcataaacaacaaagacaagcactggtctacaaaaccacctgtgaacattttgcccatctgtgttcccacttgaatttctcctaatttgcagcagggcccaaggcatttacagctgccatttgcagcagaagagcagaaatgatggtcattttagtccactgctcagaagcaagtgagccagtgtgacctgcaccagcagactgtgctgggctagggggctgcagccagcacactccctgcaggccgcttcctgagccccacccctccatgactacactaaacaggcttcctaactttgggcaacttgatcatagatgtacacatgtctaattatggcaaaggttttttaaagcatttggcagtattctccagtctgtttctgttaaattttctttgggaaaagacagtgagctcctcactcccacatccactgatgcatatacctcagtgcagcgcagtttcctagcgctagtgctgctaaattccacccaggcccttccatgcatgtaccagagagaaggcagggtggatacagctcctgggcgccgtagagtagggagtaattttctcctaggagcgtgggagatttacgcgccatatccctgtgtgtggagaaggaagaagccccaaaaccagctctgtgttgtgtggtgtcagtggctatggtcaaggtcccaggaggctggttcccgggaggcttgtgccaggaggcttgtccccaggaggctggtgctggcaggctggtcccaggaggctggtccctgggaggctggtgctgggaggctggttctgggaggctggtgccaggaggctggtccctgggaggctggtcccgggaggctggtgccaggaggctggtcccaggaggctggtcccgggaggctggtgccaggaggctggtcccgggaggctggtgccgggaggctggtccctgggaggctggtccctgggaggctattcccgggaggctggtccccgggaaactggtccccgggaggctggtgctctgctgctatatccagggggattgggcctttgagctctgttccctgcgtggcccgatgtggtgtgcaggcctctggggataatacaagtgcagacagagtggcagttctttctccagacccattcctgaaccagagctcctctctgggcccaggcatctgccagcctatgcaggaacctctccagcctactctcccaggtctcttcctgcccacctgcctgatcatattgctccctgcaggggctgccctgtggccaggcccccaacacccacaagttacacagtagaactcaaatctggttttaaaaggtggtcttcaggatttaagttatccttttgcacttaaaaatgaattttgtgcttgaaacaaccatggaacactgcctattgtgtccatccgtgacagttttctggttttgaaactgtgtgagcacatcagcaccaggtgatacgaaccctcagggtacctaagtccaggggagagtcacccagaagagaagggtgcaatgggctgcgtgcagttggcatccctaaccacccgaccggccatcactcactctcttacttgtgccccaatccctgactcatctgtgtattgcaaagagcatgaggatgtacctggcagagcgcaggcacacggttcataatgatggaaaggtcaaccctggcctggaggagccagagtatagtacaggtcactgtacaggtaaacaggcgattgattgcaggagagggtgggtgattgacctgcgtgtgggaacagagggtcaccgacaaaggcgcctggtcagcccaggtcaggggagacttcccggggcacagatgggaggatccttggctgagggtcagcctgagcagaggccaggggacatggcccgaagatgagggccagggacgggagaggtagcaggcagccctgggagggcctcgttgccaactgctcagcactgcaaaatctgcagatgctgggcaggagggtgccatcctgtaacttaactacttaaatatcctgtaacttaaatactatcgtataataatcatatcatataaaagtcagtgcaacttacattacatggtgagataagagagagaagaaaacaaaggtactgcttaatatacacattcacacagacatattcataataaaataggaggaaatacttacaacaattacaatcctcatttctgtagctgttcacatggtcgtggctggtatttataattactttgtctactatccaatctgtattccccttcccttcagaaagcgcctcagctgggcatggacccttacctggtggggtgacccgaaccttcactcctgaagggtctgggccatttttagtcctgtctggattgggtggttatagttttccattgacctcaggaaggcttgagcacaggccatgagtggtgctccttgcctcctcggggttctgagcctcttgctgtccctgtgcagttgaccaagtccacacggtgagagcgctcccgccggctgcctgacttctgtggagccctctccttggtgctgaggttccccaaggctctggcctggccatgagttccacagcagcattcttcaaatgatcaatccagtggattgggacccacatttttatttagattggatgggataaacagaatgaaacagggtaggatagatcttcatggtgagcatacagtagggacggtacactggggagcttctgtgttgctgtgtgcgagtcctgacataaaacttaattcaaaaacatctcgaagccttaggtcgacaaccccagcccatagaaggcacctggtgatgattgtagactaaagagaattggaaaaactgctgccagtaagttttcactctcacgacttatgggaaattctttatgggccagaaaaaaaaaaagttaactctctctttatgggtgtggtagttttagtttcagtgagtaatagaatattgaaacttgaaagagcctctaaagatgttttatattaaactctccattttccatgatgttcctgaggctcagagaccttcagagacttgcctggggccacacagcatcggcagtggagctggcatgggaatgctggcctcctgcctcctgtgttgggtccaagtgctgactgtggtggcctcctagtccctgggaggtcatggcccgtccaggagtcccacagtgagacatccagggtagcggctggcaggagaccatgaggctggccttggggggagaaagggccctaggtgtctgccttctgggtccacattggacccagccacagccagaacccatgcaacaatgaatcacttaccagtccatgtggatgaccgacataatcaagactgcaaacccaatttggtctgaaaggaacagaggacctgacagaatgacccataatgacagcagcaaggcctggtctggggcgtggagtctgtgggacacatgtgtgcacccacccattaaatatatgtatatctcatatatgtgtgttactatggcatatacactcatgatattatataggagtgtgattatatttttcatgaaaccccaggaacatccaatctgaagaaatcttgaggatgaagctcttttgagtggccaggcagctctctctaaagtgaagaatcgctggcttataaatgtatttcctctcgagtggaggcaccctgcaataggtagacccttactcgtccatcccagttctgtcgacaggcagccggggaagccagctgctgccagcgctcatcccagcttctccaggtttaccagtgccattcacttccgaagtgacagctacactctgctggcacaggctggctgcatgctcccaccaaccagggtggggaggggcctgctgtcacctgcacacactggcatgagaggtagaaggggctggatctgacctcacccagaactgattcacccacgtgggaaccatcatgcaggtcttaggggagacctgccctgcagcctgctcacggagccccttggcccatgctctgtcatcaggtgcagccacagtctgatgcatcgctgggctcccaggcccactgggggcttgggaacctcaggtctgccgcacagcaaagtcactgaagagtctcatggtcagccatgggccatggaaaccacctctgccctggccacttgtgcctggcagctctgctggttagtggcactggcgttggctgggcagaaggggtcgcagagtcagccccgtgtggctgggagcaccggcgactccaggtcctcttcctgttcccctattgtcaggctgccttccgagggataaggggagccagcatgtgcggctgaaaatgaacccatcctgaaagcgtgaatcccagctgccaaaaaacattttgaagttttccagacagccttttttggaaggcataaactgctggagcatcgcttcactggtgacaggagtggcaacctttctctaagttaggaatgtcccgtcagagcacaggccctcagtggggcagggcagtggcccagcctggtctgagcagaggtcagtggtggcctggaggcttctcttgttatctgcgccctcccaggacagcaagtgaagctggctgtccccagttctcctgtagaaactccgtggcctctgcattgggatgagacttctggatctcagcgtggttgtgagtgctggtgaccctttcagggtacaaatgtggacatgaagtccagagaggcaaggtgacctgcccaaggccacacaacgagtagggcactgggaatgaaaccaggctccatggtacccacaagtgcccactccccattctctgctactgctagtcagcttctcttctggggagaatagcctagggctcatgccgctgagccttcagaaagtggcagggacgagggaaggagcacagtcatctcaacagcgagtgaagcttgaatttggaggaggaagacacagtggattaatcagcatggagggtggacctggggtcggctgcctagtgtgaatcaatctcctgtttaccaattatgtgacttcgagcaagcttctccaccttccatgcctcagtttccacatctgtgaaatggggacgatagcacctaccaccctgagttgttgggagtagtaaatttagttagtttgacgaatgcataacatagtatttagaacaaaagtattagaaattattattaagaatttgatagttaattgaagtctggatcctagaattaaatgatccatacagatgtaaaacttatatccccgaggcttctctaaaagatcaaaggaggggttaattttgttatatgaacaatgaagggaactcaagtaaactattattcagaagtagggtttcaactgcaaagcattaaaccaaaatgcatttttaaaatagtaatacactttagaaaatgaaaaggatttgtaagtcatgtgtaatagttgtgagggttctgccaccctccccaaagggcactgactaataacgagtaactaatcaggattactgtgaaatcctacactctagtgccacacgagctgaacaagcaagcgatgcgtgtgacagtgtggctggggcgagcgatgcacacactgcatggccgggagccccggcacaactcaattcccacatcaagtctagattctgttctgcaaaattctactgctgtgactgccttctttttcaactgatatattctcacagtgctttcaaagacatgggatttttttccagccgtccatgcccagaaaaactcagtgatggcattagttcagaagaaaaacaagcgcacaccccataaactacatcagaaggtaatgcccacacatcagacccagccgtctgtccctcccagaaggcaacaaagtcagcatggcggggcatctctgaacattccacagcacttgccagcactctccattttggtcccataactgagggaaatgtcgagaaagaacagagagtgctgggttcggcattctatttgttgtggttttattttgttttttcaggcactcaggccatgtggtgcaggagccggggagggcactctgtaacctcaagggaataagacggcttcataccatcatctccctctaggggaagtcactcctgggacagtttggtttttattcacctgataagctatgtgcttgcttattaaattccttccaggccgcatcttactacattataggacacatttgtatatagcatgagaatgaaactcattaatcttttcagaggattcacactctgtctggatctcaaatagaaccaataggtcaacttcatgaaaatgttattgctataggatttctttgtaagaccagcagaaatggctagatttatggcttcatcacctgccttctaactcttatttattctctctttcactttaaggtcaccttacaactcccctagacttcagtttatttagtgtgaaaatgggaataatgtctttttgtactcatgggaatactataaaaattaattattggtttgtatcagtcagggatctccagagaaacagaaccagcaggagacagagagagagagagagagagagagagagaatttatttattttaaggaattatgtgactgtggaggctggcaagcctgaattctgtggggcagcccagcaggctggaccctcagtcaggagttgctgtgcagtcttgaggcagaaaatcattgtccacaggatgcctgtgattgctcttaaggccttcagctgattgggcgaggcccacccacattatcaaggtatgtactttcagtaatctcttttacttaaggtaaactggctgtagatattaacacatttgccaaatgccttcatagcaacatctagattagtgtttgctcaaacaactgggtacctgcctagccacactgacataaaactcaccatcaccgtccatcctttgtcagcttgacatctccctaaactatacttagtttccacataaagacaaaagcaaagtcatacttctgcctaatatgatacaacaagcctgactacaccaagagtgcatgcgcccttcccagaagaggattcagagtctttgagtggtgcttcgtcttcttcttgatatcttgtaacttaaatactatcatataataatcatatcatataaagtcagtgcaacttatattacatggtgagataagagagagaagaaaacaaaggtactgcttaatatacacattcacacagacatattcttaacaaaataggaggaaatacttacaacagttacaatcctcatttctgtagctgttcacatggtcatggctggtatttataattactttgtctactatccaatctgtattccccttcccttcagaaagcgcctcatctgggcatggacccttacctggtggggtgatccaaaccttcattcctgaagggactgggccatttttagtcctgtctggattgggtggttatagttttccattgacctcagtcacggggcattgtgattgagagcgtgctaggagacaccccaagggatctcctgtatcccagacatgctcttgcccatgtccactatggagtgcagtccagtttcccacggtggtcaggatcagtcacccgagccagcacagtagttcccgttcctgcctttgattctaagccacaaggatcccaaagcggctgagtggcagtcttgaattccagctcaatggaatcattgtcatgtttcctggtggcaacattcctccccctggaaccaagacctctagactagtagaacataatgttgtgagaacaagaagcagacattttgctagtgggttactaggggtcataataagtggtgcttctcccatttctgccccatgattcctgggcccatgagtcctggctgtaggagaaatagcaccatatatttgatgctgattcagagcatacccagccttctggagaatattgtcccagccctgcaagggactgtcacccagctggtgctgtaactgagtcttcaaaaggtcattctacattctgtcaagccagctgccagcataatggggaacatggtagagccagtgagttccatgcacacgagcccattgctgcacttcatttgctatggagtgagctcctcagtcagaagcagtgctgtgtggaataccgtgatggtggttaaggcattctgaagtccatggatattcactttggcagaagcattgtgtgtagggaagacaaatccatatctagagtgaatagtatccattccaggaaggacaaaacaccattgccccttccttgatggaggtggtccaaggtagtcaccttgcccccaggtggatgctgaccatctcagggagtggtgacatgctggggactcactgttgttctctgctgctggtggattggacacagtggtagtcgtagccaggttggccatggtgagtggaaatccatgatgctgagcccatgcatcacctccatccacagtggccactctgttcatgggtccactgggcaatgacaggaatggctgaggaaagaggctcagtcattgactgtgctccacagaatcccatctgtggaattactaaagtcctcctctgctgaggtcaccctttggtgagcatttaaatggcacacaaatttcaccacatgttttcccattgaaagaggtcttttcacatgtgcttttccaatttccttgtcaccaattttccaattatgtttcttgcaagtccctgaccaaccagccaaatcatcggccacagcctatgaatcattaaacaatcacacttctagccacttctccttccaagcaaagtgcacaaccaggtgcattcctcaaagttctgcccactgagaggctttcccttcactgctgtccctcagggatgtcccagagaggggctgcagtgctgcagctgcccactttcaggtggtgcctgcatatggtgcagaaccatctgtgaaccaggctcaagtcttatcttcctgtgtgatcctatggaactgcccaggaggccacaggtgcaggctgggagagagaaggcagcatagcaggagtggtgaccataggcattttaggccacttcctcatgtaacttactggtgccttcgggacctgctctaacccgatcatgtgtccacccttccatttggtcatggaatgctgctgtgcacgcccagctttatgcttggtgggtcagataacaccagttcacagtgggcagctctagttgcatggtaattggtggctcatggtcaagcatttagtctctaccaaggcccagtggcagaccaagaactatctctcagaaagagagcagttgtccttggaagacagcagaggcttgctccaaaatcctaaagacctgcgcggtgatccacctgccaaaggccccacgtagcatccctgtctgtcctaaagacctgcgcggtgatccacctgccagaggccccacgtagcatccctgtctgtcctaaagacctgcgcggtgatccacctgccagaggccccacgtagcatccctgtctgtcctaaagacctgcgcggtgatccacctgccagaggccccacgtagcatccctgtctgtcctaaagacctgcgcggtgatccacctgccagaggccccacgtagcatccctgtctgtcctaaagacctgcgcggtgatccacctgccagaggccccacgtagcatccctgtctgccacaatagtgcctcaggcaccactggatctcctgggtcatgtggcccaagtggtagagcatctttcacagcagcctggacctgttgcagagcctttttttgttctaggtcctactcaaaactatcaattttgggggtcacttaataaataggccaaattaatacacccatctgaggaggatgttgtctctaaaaattcaaagagccccactcacctttttaactctggctataggaggggctagacgtaaccactttttctccaccttacgagggatgtctcagtgtgcccccacaccaccaaacccctagaaatttcactgaggtagaaggcctttgaattttaattcaatttatttcccatcctctgacatgcaggtgtcttaccaacaaatctagagtagttgctgcttcttgctcactaggtccagtcagcacaaggccatcaatgtcatgggccatctcgtatgacatcttgaggaaggcaaaggtgatcaccatccctgcaaactattttgtgacacagagttggagaattgatctacccctgagtttcattgctggccttgcctgctgaaagcaaactgcttcagtctttactaacaaaaaaagcatttgccgaattaatcactgcatatcagataccaagaggtgtggtggattaatttgcttaaacaacgaaaccatactggtatggcatctgcagttggagtcaccacctggttaagcttatgataatcctctgtcattctccatgatccatctctcttctgcaccggccaaacaggagagttgaatagggatgtggtgagaatcaccacccctgtatccttcaagtctttgatggtggcactaatctctgcagtacctctaggaatgcatattgcttttattttaccattttctgaaatagaggcaggttagtggcttccactggcctttcttgcataacagccctctctccacaggtcaggaaaccaatgtgaggattctgcctgctgctgagtacgtctaggctaatgatgcatttcagaactggagaaaacccacaggatgggttcagggccatacttgaactgttgtgagaaggacatgagataaaactccactgatcacctgtgctccataagcccgtccctgactggcagaccatagtgacatttggctctcgtcaacttagggtcagttcagatccagtgtccagctgtccctgaaaagtctgattattttctttcccctaatgcgcagtcaccctgttaaggtagatccctttggggaagcctgggagaaagattaacagtgtaagattttggtatggccctggggtctttcctcaagaagacctaacctgtaaattcaagggattctgagtctgtaaagtagctcaagcctgggaattgattgaagggttgtgactctgttttgtgattcaagttatacttctgttcactagacctagaactcttctgtttacacagctcaagtaagaatttagtagacagcccatctatttctcttccaggaatataatggactgccagttgccagttgattactgccttgactgtgctgtctgttttggtaacttgtctcacggtattaccacctggtcggccttgtctttggtaattatgtgccaccatgtgggccctgccccccttgctctgggacccagtcacttccaggtttcccagttccatggccatagttcccactgtaaggtccggcctgtggagaagtgtgactccagagcttttcaagggtgcgaggactcccctcacacatctgtttctcatagtcgtggtgaaaggcgtgtcctctggaccctcctggggtgggaggaaatattagttacttccaatttctgattattgtgcaacttggtaacaaacagggactctggaagcaatggggaagaagccatcagaccctgaggctcacaaaagaggagatgttcatgtttgtttccgctgcagtcaagctacccaaagtttttaacaccttggagagacctggctgcaaatgtttgttttaggaacatgctaagaccatggagaatgatgcctctgtgacatggagagatgcaagggaattgtccctcagtggaggcccctttctccctgtcacaactgattccctcagctgggctttgaggactctgccagaggtggtatagacagggtaggggtgaacatttagagtcttctcttagaaagaggcacccgtacaaagtgtgcctggcaagaggtcaccaggagaggaaggatagaccctcgctcgggagggtccccaattcacagaacatagctctagaaaggagaacagatggcatctgtgctggtagacctgccagcccccacactgccagcaggccgggctgcagcatttttacaggggatcattcagtttcttctaaaatacttccagggacaagagctcaccacttaatgagggggcttgttttatggctggactgacctattaaaagattcatcctcttgtcgggcaaaatctacagagtctacacacacagatacacatccacacacaaatatacacacattcatacatatacatacacatgtacaacatgaactcacgtacaatgtgaacacatacaaataacattcacatgcaataagcatatttatgtatatacatctacatgaatacataacaaaaatacacatacaaacatgactacatgtacacacattcgcgtacatataaaatacatgtgcacacatgtaaacatctgtacacatatacagatgcatacacaaatacatacatgcatacatagccttgcatacatacacatcctgcagagttgatccacttctgccaattctgctccctcacaatcgatttcctcttctaaaaatagcccttctgatattggaagtcatccttccaagactttttttaaagagactttattttttagaacaaatttaggttcagagaaaaactgagcagaaaatgcagaaagtcctcatatactccctgctcccacacatgcacaatctcttctactatcaatggcctacaccaaagtggtacatgtgtcaggactgatgaacctaccttgacacatcattacccaatgtccatagtttacgttaggatttactcttggtgttgtccaaaatctatggattttgacaaatgtataatgacatgtgtccagcattatagtatcatacaggatagtttgactgccctaaaaatcctctgtgctctgcctgttgatcactctttcacatctaactcctggcaaccactgacctttttactgccttcatagatttgccttttctagattgttatacaattggaatcatacacaatgttgtagcctttttgcattggcttattttatttagtgatgtgcatttacgtttcctccatgtcttctcatagattagtagctcagttctttttagcactgaataatattccattgtccagatgtaccacagtttatttatccatttacttaccaaaggacatcttagttgcttctcagttttggcagttatgaatacagccgctataaacatcttgtgtgggtttttatatggacataaattcggataaataccaagaaaggagattttaggagtatgtaagagtatgtgctgaggtcggtaaaagtacatttagttttgtaagaaactgccaactctcttccaaagtggctgcaccattttgctttcctaccagcaatgaatgagagttctcattgcttcatatcctcaccagcattcagtgttgtcactgttttggattttgccatcctaatagttatgtagtggtctctcattgttattatactttgcagttccctaatgacatctgtattaggccattcttgcactgctataaagaaatacctgagactgggtagtttataaagaaaagaggtttaattggttatggttctgcaggctctacaggaagcatagcagcttttacttctggggagacctcaggaagcttccaatcatggcggaagacaaagagggaacaaagagtctcacatggcaggagcaggagcaagaggggagggaggaggtgctatacacctttaaacaatcaggtctcatgagaactcactcactgtcacagggagggcaccaaggagacggtgttaaaccattcgtgagaaatctgcttccacgaccattcaccaaggatccgtccccacgatccagtcacctcccaccagaccccacctctaacaccggggattacaattcagcatgagctatggtggggacacaggttcaaaccatatcaacatataatgctgagcatcttttcatatgcttatctgctacctgtacatctttttttttttttttttttttttttgagatggagtctcgctccgtcgcccaggctggagtgcagcagtgctatctcggctcactgctgcaacctctgcctcccaggttcaagcgattctcctgcctcagcctcccgagtagctgggactacaggcgcgtgccaccacacccagctaatttttgtatttttagtagagacggggtttcactgtgttagccaggatggtcttgatctcctgacctcgtgacctgcccgcctcggcctcccaaagtgctgggattataggcgtgagtcctgcgcccagcctgtacatcttttttaatgagatgtctgtttagatctttgctgagtttttaattgggttgtttgttttcttataaagttttaagagttctttgtacattttagatataccacagtggtcttttgcaaatattgtctctcagtctgtgacttgttttctcattctcttgacagtatctgtttcagagcacaagttgttaattttcatggagcccaatttattaactatttcatgattgtgtctttggtgttttatctaaaaaggcaccactaagcctaaggtcctctagatttttccatatgttatcttctaggagtttcatagttttgcattttacatttgggtccacaattcattctgagtgtgtgcatttgtgtgtctatatctgtgtgcatgtctatacttgtgcatgtgtgtatctatatgtgtgtatgtctatatgtgtgtatgtgtatgtatatgtgtgcatgtctatacatgtgcatgtgtgtatatgtttgtgtgtatatgtgtgcatgtgtttgtgtatgtgtgtctatatgtgtatgtatgcatgtatgtgtgtgtctatatatctgtgtgcatgtgtgtgtatgtcttcatactctgtgaaagagagaaagaggctgcatatttaaagggttaggctgagaaccctcctgctctgctggtggaaatgtaaaatggcacaactacttgggaaaatggttcagcaattttttaagaagttaaacatgccacctgtcactcagccattccactcctaggagaagcagacacacaggcctacacaaaggctcctgcatgagggatccgtagcagctttatttgtgacagcctcagactggaaatggcccagatgccaatcagctgatgaatgcatgcacagacagtggctcaaccctgcaaaggggcaccacccagcaagaaaaagaaaccagctgctgatacacacagcaatggaagggaagcgcaaaatcggccaagagccagacagaaagcagaatagccactggagggtcccgtgtctataaaactttggaaaatgcacacccatgtttagtgacagaaagcagctcgggggtttcctggggactggaagaagccctggaaggacagcaggactggggggcttgggcccaccgtgagggcagcggcaatgcacatcgcccagatggtggggctgctgcagggggatctgctaagtcaaaacttgtcaaatagatatttttaaaagttaagacagcactttatttttaaaaagaacatcatgtatttttgtgagtatatagattttagagccagaagagaggacgagcatgatttccatatctatttgaggatgagcgtttgaagcagctcctctctgatttaatcccactgggcaccttttgcctgatctgaccgttctgcagtcccctggcagcagtcaggacaggctgcacacgcagaggaacagagccaggctgagcaccctccgccgtcattcacatccctcacagacctcagatgcctgtagccagctgcaccaacaccccagggcgcagtcctgtgaacatgctccacctccatgcgggctgctgggtcagaggcagagagaccctggaggacctcctcagagcggaaaacatttcagcccagaagtgacacacatcacatttgcccacaaagattcccacaactcactaatcaaaactagctagatacggtcatgtgtcacttaaagggaatacgttctgaaaaacgcgtcgtttggtgattttgtcttgtgaacatcacagagtggactcacacaaacctagatggcacagcctgtgacacacctaggctgtgtggtgtagtctctggctcctaggctaaaacctgcacagcatgtgactgtgttgaacaccataggcaactgtaacacagcggcaagtaccgtgtgtctaaatatagctaaacataggaaggggaatgcgttgcactgtgatgttatgacagctgcgacatcagtaggcaacatgaatttttcagtttcattatcatcttataagacccccattgtgatctgtcattgaccaaaacgtccttatgtaacatatcatgctgcttggtcccactggatctcagagagggcaggaagcaaaatgtttccatgcgcctggcaagaagcgagcacaaacgatgaccagtcaggataagaaggaagttaggcccggtgtggtagctcacgcctgtaatcccagcactttgggaggccgaggcaggtggatcatttgaggtcaggagtttgagaccagcctggccaacatggtgaaaccctgtctctattaaaaataaaaaaatgagccaggcatggtggcgggcacctgtaatcccagctactcaggaggctgaggcaggttaatcgcttgagcctgggaggtggagtttgcagtgagccaagatcgcggcagtgcactccagcctgggcaacaaagcaagactctgtctcagaaaaaaaaaaaaaaaaaaaaagttaaattcagagctgcttctcatggtgacgttttcaaccctctacggctttgatactggaactgccttcccagttagtggtggtctcccgggggctactagatgcatgtcaagctcaaggtcttctaaagggctccagccaccagtcttggctcaggaggctgtgggagcagggccaggcatgtaagctgagaacacaggctgtgcagggcctgaggtgtggctttgcaccttgtggcccatgccatgcctttcttctccaccccaagaatgcgggccccctgcagcattccacagcccgtgcttacacagcgtatttcttctgtgcattgtgcgctatcccagaatattcctggatgagtgagaatttatcaggagggaagggcctggatctaacagccctaaagacaccacctcactgtgtcctccactctgtatcctggggtgtgtggcatgcggctgggcccctgtggccctttactagcccccgtgctttgctttggggccagaactgcctgcctggtctgttggttttccatgcatgcatccgctgctctgtcgaggaagggtttgacagtaatgcctgttgtgcaggggtcacactatgtgtgcagtgggatggtcttctgtggcctaatttcatcaaagcacaaaacttaggctgcctagaaaataacagttaatgtgtcctctgtgtgtgacttctcctaggtgggctggcaatgggagctgggccccagtggctcagagtgactgagcactggtcttgtgtacttctgattaaggacaaatccacaagctccagaaacccaacaagcaaatagtaataagtctggcagaacgctgaaaagcttaaccattatgtttttgctgaacaaaagaacccccagatctcatgaagaaaagccagaaaaccgtgcttttcctcagaaggtagatccgaatttttccagccgttggttatgtgtgcagcttggggccaggcgtttgtccactgcaaccacaacctcagacattcttctgtgggggtctgagcctggacagcagtgttctcagagcactttccaggacatgcgagctataagatgaacccatgagcagatacgcttgatcctgcaagctggagttacttagtgttgatcatttcactcttcgtgcgtcctgtctgagggttagctgagcccgttctggtggtgggcaaccacagagctgtcttctggctaatgaagacaaagccaccttctcaactacaaggattccttgtcccttctggggtggctggggtggccctgtctcctcaccaaaggctcctgggacctcactacgtaaagagatgagattactttggaatgacttatttcctcatcaataagtgatgggagttagaaggatgacccacagcacccagcagctctagccacatgtgaaatccatgcttgcatttcgggtagactcctgctccatctggaaaagatcatcttttccagagttttgctggatctcaacaagtccctggaagcgccttgtcaatctttggttctcagaatttgctcttccttattgcacgtctggggagacaccacccacttgagtgtagttgccctctggtcattcacttatttttcatctattgacttaacaaaatatttgtggagcacccactttgggacaagccctggctcagtactctacgtgcagagctgaacaaggcagtctggaggaggacaggcagttacaccaagctccctggactggctctgacagtgccacgcatggggtgcctagaaactgctgtggccggggctggtggaggatgggtcatcacagaaatagcagagccagaggtgcagatgtgcaggaagtagaggcctcggctcagccacccctgttccacaggccacagcttagagagaccctttgcagggaagtcagctcacagcaaacaaagggtgctgacatttcattccttcttcctcatgataagaaatctcttctgttgcctgaggcagagtcagtgtattagtcaattttcacactgctgtaaagaaataccagagactaggctgggtgcggtggctcacgcctgtaatcccagcactttgagaggccgaggagggcagatcacttgaggtcaggagttcgagaccagcccagccaacatggtgaaaccccatctccactaaaaacacaaaaattagttgggtgtgttggcaggtgcctctaatcccagctacttgggaggctgagaatcacttgaacccagggggcagagtttgcaatgagccgagatcgtgccattgcactccagcctgggcgacagactctgtctcaaaaaaaaaaaaaaaaaaaaaaaaagaaattaatacctgagactgagtaatgtataaaggaaagaggtttgattgactctcagtttcagctgggggtgccacaggaaacttacaatcatggcggaaggcaaaggggaagcaagcaccttcttcacaaggcggcaggagagagaagagaaagtgaagggggaagaatcctcataaaaccattggatctcatgagaactcactcactatcacaagaacagcatgggagaaactgcccccgtgatctagtcccctccctccaggtccctctttgacacatggggattacaattctagatgagatttgagtggggacacagagccaaaccatatcagtcagtggcaaaattcatcattggaacagctcatgtaggcccagacactgttgtattccatgggtgaggaggttgctgtccaagccacctgctccaggacacatgctggggcggggtctaagtctctttcttttccactcacccccttgctgtctcagcctcacatacctaataagacggtcccaagagcttagccataggagatagactaatgcacagtcctggatagcttgtcctgcctttttgcatggggcacgtcttgttaaactttttccacactctatttgctgagactatgcagacacagggagagcagatgcctggcagttctctagaaggcaggggctgtgtgaacagcagttcatgtaacttggtctgaagcaggccattttcctccatggttatattgccaattcagggagaagcagagtcctgggccccctgcactgtgtggccctgtagcacagtgtgcacctggattctgacatctcagcttctttcaaattcccatccttttctaattattaattagattgttaattattattaattagttaatatgattaacaaccacctgtgacctcatggtagcagctccttatagaaatgtaggagcagtccccagttaaaaattagatagggataaaagcccaaatcagggcacttattcagggaggtgccacctggccagggtctgggctgctccaggaagacggtggcaggagaggacccggccaggggcctcccgggccctcctcacctgcactctcggtggtctcgggccggtgtgcatgcagggtgtcctggaagcaatcttccttaagaagcacagaaagaggaaatccaaaccatcctgcagagcttgcggggcttcccgacggggcttcccgtcagggcttggcaagctggcagccatcaggaaggacttgtggaaagaagagctttgatttacggttgctgcctcagaaaccccgatccaattgatgaaccgacctgcggctgccttctggttggatgaagtgatttccatccatctgtttcatttaaaaacaaaattcaggaagtgagcttgccatacctgactaaataatagtgtgtttaatttttcctgtttcattccagacatccttcagaaggaggccagattttacagagatttcatctgaatgcattccatttgatctaataatttatggctgtgttgtatttgtcctacagaaagccagccagacgcccgttggaaatccaacacacagcaaagttatcctaatggacagggtcgtgacacactcagacatatcccagggcagacagccctgctccagcctcttatttctgtctgtcctacctttggcctaatctcctttgaagcaattttaaatgaatgaatgtggtgctataaattctacccgactcgtggggcctttcctaccttagtgaaaagataatgtgttggctgagatggcaaggagacagggtcacatggtgttgcagcctttcagatgcgagtcccaagaatctaaagagaactgacagcctggcatttaatcgcccctcatttaacagcattaactcaagttaactcttgcaaagctctgtgatggattttcccagggaagcggcttcctgcctagacatacgagcgcctcacacaggcctgggctggccccattcgacgcctgggcaccactgggagcctggagctggggttgggccctgcagagccagagcctcttggccatgggcagctgtgcctgggcttgtggctggttaccaagcacaagttgacatcgtgttcagaatagggcgtgctctgaggcccccatcagcatttggcaccaaattgggacaaatacaatgaggtctgagcccctattttatttggggaggctgtgggggatgtaaaatagcagatataggtgataaagaaggcctgagcaacagagccatgccagggttagagcgacagagaggagagagaaataaaccctctgtaactgctcatctgggattcaaagaagatggtttctgaatgggacctaaagcacaaacaaggttcaagggggagggatgagggagcatatgtgtcctaggtggagggaggaagcagcgtgccatgtcctgctgccgtgcccagctcactcagccacccacccaccccacccactcctgcctgcctcaggctacctcctcccctgtaacactgagcctgagaggcctctgagccccccgtgcacagccagcaccttagccgcaggctgtctcttttttggggtgtccctgaaccgctctccttgtgcccctgaaccgctctccttgtgccccttgatcatcagcagtgctgtcattacccctagggtaatgctgccctcccacaggggcagaaagtctttatagactctgtcctggaaggtgctggaggccaatgaggttatgacaggggctttgatgctggagactttctgtgcctctgtgtggcctcctcacctttggtttgggggttcgtggcttccatttgatgcacagtctgggccgggctgaggaaggtggcaggtgttcagaagacgcaggtggccagggaagcttggccgcacctgcgtaagagcacacacctgtgtgtgggcaggtgtaagccatgcagtggctctctagggaggtgggtgtgggcacatttgtctgcagcagtccttttagcagtgggagaaagagctgaagttttgagccggacagttagttatgtgtcaggctgtttgagaggagaaacccctgtgggtttctgtgagccatttgggctgtaagtgtgagctagctgcgtctaacaaagctctccccctaacagagaaggaggggctgtttccactgtggatgcagctcgctactgatgggaacctaggtggtccagagcaggccatgatccctggggacaggcggcagcagtgggaggccctcagttggcctgaggctgggattacagtccgaaccgcacggggcttatagccatgggcacagtgtccctgcttcagacttacccaggtttgggcagggggggagaacgcaggtgaaattccagaagcttcccgctggtctgccctggacagcatcgggccagccccttacttttctccaaagcatcgcagatacttcaccaccatcacaggaaacagtggggcagagccagatggatccagtgatccgaggccctgcacaccctgggacaggaagcacagcaggactgacagcaagtgcccagggccagtgccctgtgtgcgccaaagtctacactcactcatagtccagcaaccctccagagccagcagggaagggcagcacccctccctgaatcacagacattaaaatagcacctttcagtgttttttgtcttttgttttgtttgggttttttttgtttgtttgtttgtttgtttttttgagacggagtctcgctgtgtcaccaggctggagtgcagtggtgcgatctctgctcactgcaacctccacctcccaggttcgagcgatcctcctgcctcagcctcttgagtggctgggactacaggtgcgcaccaccacgcccagctaattttttgtatttttagtagagacttggtttcaccatgttggctaggatggtcttgatctcttgacctcgtgatccacccgcctcggcctcccaaagtgctaggattacaggcgtgagccaccacgcccggcttcagtattatcttaaatctccgagggctacaggactattgtgtctgccaaatggattcttcatttctccacctcctcatgctccaaagcaaacccacgcaaagtggctaccagtccccctgccttccaggagctgttcagaatttagtacctgcagcttcttgggtcttaaagcaaaagctgggagaggaatgggtcgagaggcagcctggggcgctgaagccacccacctacttctgcctcatacagttggctgtgggtggggacagggacatatgccacagaggctgacacctgccctgtagccagggcttctcaaccttggcactatcagagccagataatcctctgttttgaggactgtgctctgcattgtaggatgtcgagcagcatcccaatttctactttgtggatgccagtagcacgctgctgcaccccagctgtgacagctgaaaatatctccaaatgttgccaaatggctcctcgggggcagaatcaccctggttgaattcctggttcctctgaaacagtgactgagtgtcagcactctggggcctggctgcctctaccttgggctatgctgatattgattaccttaagcaactcatttctctttccacatcttcacgagcttcaccttcatcaacaaaagagccctaggccaaccaaaaacttcctgtggtgaaatttagcttgttggagctgactcttcttgctcagctgaaactgtgcctgctgatgagtaagtcctggagatcggctgtgcccagagttagcagtactgtacggtatgcttagaaacttgtaagagggcagatctcaggttaagtgttcttaccaaactaagaggaaattatttaaaatttgcttattagcacagcaaaggctggagaaggctctataagggataagctgttacctgagtcctccactcagccctgcccccaccaggcctgctagcacccacagcacaaagttctccagacacagtggggttgtgggcacagtaccccaagggggtcaagtgaagatcaaatgagatcatgtatgtgtcagtcctttgacaactgtgcctaaccccaaggggaggtactgggtagcccctgggtgaggtactgagtagcccctaggggaggtactgggtagccccaggggaggtagtagtactcaaatcccatcagactcttcagacagttcatacaaggaggtctagaacccaagatatttggaccttcaggtgaagcctggctctagcatgtcaaaggctaaaagatactggactttcctctaaagctctcgggctctccatgagcctcaaacacatggttatgaagtgattgtgttacaggaaaggggtcccaatccagatcccaagagagggttcttggatctcccgcaagaaagaattcagggtgagtctgtaaagtgaaagcaagtttgttaggaaagtaaaggaatacaagaatagctgttccatagacagcagccctgagggctgctggttgcccttttttatggttgtttcttgatgataagctaaacaaggggtggattattcacacctccccttattaaaccatatcgggtaacttcctgacattgctgtggcatttgtagattgtcatggcgctaatgggagtgtagcagtgaggacaaccagaggtcaccctcatcaccaccttggttttggtgggatttagctagcttctttactccaagctgttttatcagcagggtctttatgatctgtgccttgtgctgaccttctgtgacttagaatgccttaactgtctgggaatgcaccccagtaggtctcagcctcatgttacctagcccctactcaagatggagttgctgtggttcaaacgcctctgacaattggcctgaatgaccgttggcctaggagaactggaaatccttgaagcttactgcactgccccgggttgcacaccctcacgtggtgactgtcaggaactggcccagagtgggggaagtcactccccgttcctgcacaggcacagccttcacgcccaaagaccatgccgctccctgccctccatgaaaaaagtgacaggtatatgggcccaccacaatcattcattccccacagccactgtccttggaggctccttcattcttacctccccaacccaacctcaaagtcccgaaacgggcatagagttctcccagctgtgggctgagaggccccctcccgccagacacatgctgaggtgagaccaggagagcctctcccagcaggaagagggcagttaaagggactggggtcacagcgcctgttgtagtcccttgagttgctgtaacaaaatgccacagatgggtgtgtgtgtgtgtgtgtgtgtgtgtgtgttggtgaggggtgtcagcaacaggagtgatttcccacagttttgcgggctggaagtctgagatccagacaccacagattcggtgtctggtgaggactggcttcctggttcatagacggcgccttctcaccgtgtcctcacgtggtcaatagggcaagggagctctcacgacccgatcatctcccagagaccccacctcctaaggctatcacactgggagctggggttgacatgactttggggaacatgtgcattcaagtgcagcagccccacacccttggcatggacctgcaggaaagatcctgccctgcctttgctggagggttcccgcaagggcctcctcctcacctctccccactgctcatgaaatattactggaatgattagaaagctgagagagaccctggggaggaggtccctgagtgtcccatccaccacagtgaagaaggggccctgccaagggctttgagctctgcagccggagaggagctgcctgattggaggccgcctttggggcaggcgattctagtgcattctatgacctaacggccttgttaagtttcacacttcacgctggctcccagtgtatttttcattccttctctctctcagttcccataaagccgtctagctgtccctgtgatacattcaaacttgcactgtttggattccctaggctgtctgaaaatgtgtcctttgagtaaaatccttctccctcaattcccagttacgtctttaaatcaagatgggccctccagtctctaaacaccccatcagtgtgagatggcaccttgtttgcttttaagacctgcgatttggtttgaatgtattcagttatctagatgtcttcatgctttccatgaaaatgtactgaggttcagtccttggcatttttccttgcagaattcttctctattatttggatgtctggtatccctacaattatacatgcttccaacatttctgtcaacttttcctaagaagtttgttggaatgcgctttcatttttccatcccacacttgtttatcaaaaatacggtgtggtggggaagggagagagggggagagtctgagctcgtaggtaagatcttcttgctcagaggccatgcgacgggcttatcatacaggttgggtctagccctgggaagctcatgacaggtgagaatgaaacccgctccagttacttttgctgcataacaaatcatctcaaaactcagtggcttaaaaccatagtttctttgtgaaactcagggatgctgtgggttgggaattggggcagggcatgacaggaaggctgtctcttgtccaccatgtttaggccttagctgagagaacctgcaggtttcgagatttgctggcgggagctgcagcctcctggaggtgggctggcttatgtgtctggcgggtggtgttgactgctggctggaaccttggccgggctgcaggtcagagcaccagcacacacttctcaacgtggacagcatgagcttcctcacaatgtggcgactgggttccgagagtgagtgcacggcctgcccttgaccttgcctcagggtcacgcagtggcatctcccctgagccctgcttgtggaggatgtcacaagaggtctgcccagcacacagggtggggacacggtcctgtgacttagttaggggagtgccaaaggctttttgtagaggggggctagtgagtagagacacagtgttgtggctgtatttagaaaatacaatttgccacatgatctaaggttcacttttagctctgtgacctatcattctttccttgagttcagtaggaacatttcttgtctggcacagctgcctccggtttggtactttttaattaagtgcgaaaataagttccaccgtatctgttctccctggggtgtcgggatgtccagcttccaccggcctcatgggcagaggaagcagcagccagggcagggccaggtgtgcccgtacaggactggcagcccaaggcaaggggtcagggctctactcccacagacagagccctgcacttttgtctcctcatttttaaaaaatgaattaaatgatcattttcttaatgttagaaaggagggaatgaacccccttgtgaacctgctaaaagccaattatccacactgctcttaactttgcaattctacgggtttcgcagacccccaaaaccatccacagaccactgatgaagaccccgggactcactgccctcagagccttcatacggcagcacctaacccacctgcagcacgaggatctccctggagctcttgctccagcccagcccggttttgctgacagcccctctgcagcccagtggtatgcaggtgacatgtcccctgaggccacgcgtcatcacagcctgagggaagcagtggtttcaaccctgctgtgggttgaggacaattgtctagaggaaaggaccccatcctggcacttctcctttagctgagaggtgatactttcttttccaacatagtgagaaagcaacacttgcatatcaaccacattaagacatctgctttcagaaaagaaggcgttgtgcccaacatctgcatggcaccaaacatctgtactgtagccttgttgatgaccagagcaggcaaggcggcatctcccaggtgcccagcacttgagccccatgtttgatccccacagccaccctctatgacaggtgctgtcgctatccccagtttacagatgggagaactgaacagaagacataaggcatttgttcaagggtgcatggctggtgagtagtgaagccagctaagatggccatgaggctgagaaaaagagagtaataaggagaggagtccagatgccagcccctgttagtcctgagggtgccaaggtcatagggaggtgacatcagactggctgaattagtgtctcagggggcagccaacacttgtcactcaggaagtctcgcagggtagaggtcatcccgagcagccatggggtgctctctgctgccctgtgggaggaggaggaggaggatggagacgaacaatgctgtactggcatgtggaggggtggagcacactgggtacaggctcctaacctctgtcttggcctcattcccctcctctcctcctggatcccctgggctcacctggctgcttgcctgggcacagggacctgggacattatgacctccggctctctctagctgggacctcatggagggcggttcgctgttctctagcttggagcttggggcatctgtggatggtttgatttgtgtggtttctgtcttaaaagaatgtctagaagaagcggcagataaaaggcctggagctcactggagagttgggtttgagatacttcagccatggaagggagaactgaagagccaagctgtgtcattgcttcaggcaagaggacaccgatagggaaacagagggacaggcagcctgagggcatttctcacctgctgctgccaaaaagaatctgacagctgttcagaaaggcaggagaagaaaccctaagacgtgtcaagaaatccatgagaggggaacatctcaatggagaggtgagggggaggccggggccctgcagacgtcaggttgggtggcgagggtccccccacacaggtctctctgtgctcaagctccagtcaccatgctgtcaccacagttgctgtgtctgctggcagctggagggtgcacctgtgccttccactcagcaaactgagtttgagcaaatacggaaaaacaagtttattgcggctatgcttctggcagcgttcctgcccacaggccagagactggtgtatttcctccagtttggagcttctggtatgttctcggtgactggtcaaggctgggctatttcaggacttggagaacctcctcggcctgttattgctcgggaagtttccagaaggctgtagatgcgtagctggctgtccagtcccattgcatcttccctcttgagcaaatagctaaacgtgcgcttcatccctccactcaggctgtgctaataggaaaccaaagcggccaaggggctggacatgtggatggagggctctgcctcgcagcacctccaaaacagttgccacttacagagagcacactaagtgcagacgctgtgctgtgtgctctgcaaatgtcactcctcggcctcccctctgcaccgagacaactgctaccatgagaatcctgtcttgaggaagcccagaggggcaaggtgcctgcccaggtcacaaggttgatgagcaattggccaagtcactgttttatcaccacggaatcactgctggagtttggtaatggtcgttgtatgtgaatgcctctgtgctcccctacaaaatgactgaagcagactcagacctcaacggtgcattctagggatgccttccagttactgaatggcgtactggggttatgtgcattgccttgcttaattttcacgataaggcagtagagccacagttaaaatttggcctcagcaagtcccgggttcgaatgcggcttgtgcagcttttgagttgattaccctgtgtctcttgttcagcatctcagagcctgttttttcttcagggctgctttgagaattcagtgaatgaatgtatgggcaagacttaggacagtgcccggctcatagtcagctctcaagaaataggtctcagcatagtaataattatcattatatttagataattatgtagtccgttttacacatgagggaagtggggctaagagcagttcaggaacttgttcaagatcagccaactaataaataccagggacacccagctccatctgttgccaaagctgtcgcagcatcacgcacttcccgcagaacaccgtgctgtggctgtttatcttcttgaagttcctcagggagtcagtctcttttgtttcaggagctccctgacaccgtggtgaacttggccggtcatccaaacccactcccgcgcccagcccggggccatgacccctaagagggggagagcagtgttcattttgctcttcaccatcgttttgagtgctgtaaatggtaataatcctgatgcccagggctcagcttccaagaacaaggatgccctcagctccctgtccctgcctgcacctccggctgcttcctctcctgcaggaggaagggcagggaacaactgcttcaccactgataacagcaagagagcaacacgatgcggcggtcacgtcttccaccaaaaacaagctagagaagcacaatagctcagcacttcactggctgctgcctcccgttccctgctattttcatgaaccaattttctttatcttctgtctttggcaagggcagcatttttgaagatgcatgttaatgtttaaaatacccaatagctggtgcacaatttttctgtttcttttaattatctcgttcactttttcctctgtattcattgtagatcttctattcctctgccctctctaaaaatgcgttgcatatttatattgttataaaccctcctgtgctcttccagtaactgttctcagcataaccagagaggtgccctttccccactaaaattttaacagagcacagcttttaattaccttttccccatctccgacaggaaaatttccgaacataaaataataatcaaaaaacttccaagtataacttgcaacccgagagccagactcaacaaagataagtccccgtttctttcttctgaatatctaaagtttcctgcaagccccagtggtgcctctcacatgtcccaggcctctggccaggttccagcctcactcactgcttgctagatgtcccactggagcgtatgctctcggtgcccagcaagaaaaggtgctcccttctctgagccaggcctccccgcaagaccttggcaccttccgcctgttttcctgactgcctgtgggttgaggtggcatatgagaactacttgactgtcttttaaaactcatgttgcttcctttgacttcctatctgctgtgtcggccaaaatactgttattcaacagattgctagagggtgggaattggcatagagtttggtataaagtcaaggctggacacacaaaggagtccctggccatgcaggcacagagcacattcttgtggctgtcacccagctgtgccacatgaggtcacagtccttcgacctgctgtctccatgcctgtcccctccccaggctgcaggcgctggggttgccttccctgtaaactcctcctgtgactgtccccatcagcagccccaccatcccctgcttagctggcttggctcctcagaagcacctctgcagccagggccacatcctgctgactgcatggccttcaagccccccacaacccccgccatccctgtgcctccacctctatctcagctccttggatgctcccagcgtccaccagacaaccccagcctcctcagttggccctagaggcaccaaggtgtgccatcctctggcctttcttttttttttttttttttgagaccgagtctcgctcttgtctcctaggctggagtgcagtggcgtgatcttgtcactgcaacctctgccttctgggttcaagcgattctcctgcctcagcctcccaagtagctgggattacaggcgcttgccaccacgctcagctaattctcatatttttggtagagatggggtttcaccatgttggccaggctggtctcgaactcctgacctgaggtgatccgtccaccttggcctcccaaagtgctgggattacaggcatgagccaccctgcctggtcatcccactgcctttcttacctcaccaggcacctcgacccttggcccatccacactctggcccgcacctgctttttgctagatttacctgttccacacctctgaccactcccttggccacatcactcaccagcccaggccttttcattatccctatatcagcccagctcttgaggcccgccccctcctgtggagttacctcctgccctatcagctaatcaacagcaaagcttccctggtccatcatatctagtaccattgtttcaaaacaacattgcaactttctcctttttatttttcccctcttaaattaaaaagaaactcacaagtgatgcaataaatcaaataacagaaaagggtataacaaaactgaagtactgccctgtctccctctgaccctgcctgccctgagacctggtatcaacagtcgaggccctgtttatttctgtgctttcctgggactgtctgcaggtgctcccaggcctctgaggatccacttgtgtctgaacatctctacccagtgacaactatctccccagtctcaggtcacaaaaacatctttgtgtgtacctggtggagttaaagtgtacgattgtgttcaatcctttattcccaaagctggtgagtttttacctccccttctggtgctgaaaatagtacgtaacccatcagcgtgtgcagcgcagcatgtgcagggttctgcagattgaggttctcatgggttatcatggctaactttgcaaattgagtccctttctatctgcttcccatggtacctgacccagcgtttggtgtgtgcccaaccaatgcaaactgatcttaaatattgcctgaggcaaagagaattaagacgggaaatctgtttgaaagaagtggtgggacagccacctgtctccacatggcttaatcaagaaggtaactgaataaatgtgcacttacgggtcacatgtacaggtttacttcattttcatgaaatgacttgtatctctgtttaatgttgctttttgcaaatcaaattgtattccctttggctccttaaaatttcagagacaattttccataacttttaattgacctttaactggcactgaatcttaatttaagctttcaattgcttttgccaagtttttatactaatgttctactaaacagttaaggcccctagaggagcccccatcttaatcataacaaaaaaatctattactttaccatttgtataatgttttatagttttcctgtatagagtgtagtatgaataaacgccttcaaaattctcctttttaaatatcagatttctagatgattctttaaagtggagtaccacttgatttcaggcttcaggctgtgtgtgtgactgtgagtgtgtaagcacacaaacacacatggctttttctggatataactcataagctctcccttctgtaacatgtcagtgttccgtgcctgggcacagggatgctttcacacctagatcttgagagccagggctgcagcacagcctcatcgcaagcctccagtccctggccctccctggcccttgatctcctacacacctaccagcacctggcttctcaccttctgtctgggaaggtgggggctcacctggagccagccagacagctcaggtccacagaatcagtgtgtgcgctccagccagaagtccagcactgtagggccctgctttcaacccatgtgtgtccctggctgggggcactgagtaggtgttagtaaccctcaataacctttcttcaccttcccaaggagctgaccccttctctgtgtcttgacattactctttgtcgtctggaaatcacttaccgagttgcatgacgaccattggcttctgattgatcacttcctatgttctgtatcagaatcattttttggtcctcatttcagacccacagaagcaaaatctttgggggtggggcccacattttacattttgtggaactccctgattgtttctttgtatacagagttggagagctgagagaccctcagtggttcgggtgctctcccaaggcaaggcaggtggaggtcttggataggaatctcattttatttatttgacaaaaatatattgggaactaactaggtcctaggtatttcgtaaactatttaatattcagagatgagtaaacacattataaaaacagcaacataatcaccagatattgatgagatgcattagtcctttaaaagcgctcctatagctgtcatctcagcagctcagcgaggcagatggtacccttccaaaggtgcagaaacaaaacgcaggtggtggggatgcagagccgggccttcaccacacctgcagagtttgcacccagcagtgtggttggcgcaggatgtgttagaggaaggggagggggaagctgggcaggctgagggcactgggtggtggggagggccttccagaagagagacatcccagcagggcgacagcagcccatcacttccatggaggaaggaccagtgcacctttctcggcagatctgtctcccgcccaggccaggatgtttcagagcaaacgagacgttttgttcctaacagatccggctgtttggttttctccctgtgaggctgaactgattggagcctggccatccagaagggtcattggaatggaaagtgatccccccaacagagaggagtgcaggccacagatggaaacagcagagtgctagggggaacgtttgcagaagaaggcagtcaggaaaacgtaacagggatgccaaatccacatcccactgggctcctgaacattgcttgcttactcccagtcccaggagaaacccagcaaatccatctttccttaacataatctttcagcccagatcagccctaaattgtgtcctctaaaacctcttctcctcccacggtgttgtcccccaaatcagtctatgagcctctccccgagtacatgccaactgtccattggctattctttcctgcctcacacgggacgaccaccagggaagtgcctagaccgtctacctccatattccatggattccgtgagcatgacgattgttagtactgggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcattctgattttgcccatttggattccttgagccctgtgtctgaaaattagctgtggttgccataaccttaattatactcagcagggcagagttgcttgctgatttatgacgcacagttgtgacctgggagtagctgtcatcctcagctgctgacacggacacgacaacggcgctctgtgtctataacggggagtatcaattactttcctgcagcaggaagaacagctcagagtcttggaatgatctggacagaaacgttaaacacttgtctcgtataaattcagcccacatccatctgggctcattaaatcattgaattgctcagaagcaccaaattacatctttctaacaaattatatttttaaagctgcttgtttatttcacatctggaagttgaggcaaaagccaaaacttgcattcaaagtctgagaaatcatctcgccctttgccttcctttctttccttggggaagagagaggaggagcaggtgtttggaagaggtggaggatggcagaaggccacaggtaggatggcgctgatcctgtgggccctcgcagcctcagtttgtgtgtatgctgtctgatttcacagaccgctggctgcatcccggcagccatctgtcctccttgaaggagggccagcaggaagccctcacagagacgctgagctgggaggaaggaggtgcctccgcctgccctccttccttcccgcctgcatgtccctgagagcagagtctggttcgccggcagatagcccatgggaaccagtccaaccatcgtgcacccgtagatgctctgagacacttagagttggctggtattcgggactgcgacccagaacctggcctgttctgcttccccaggagtaggaacactgcacccccaagtcagcctcaggagcccatcctccatgcctcctcctcttgccagcctggtgcaagctgggcctgtgtgcccaggggctgtgcactccataggactgggccttggtctcctgtctgcacatttttcctgagcctggcaccaagccaaactgccccaaagccatggcttctgcgccccaggctctgtgaacacgtggggtggggaagggcaaaggcttcctccctgagcatgcactcagctcgattttcagacaccaatgtgcaagcattccctcccagagctgctgaaaatccacattccctagttcattccccctaagtagtatcaagtaggtccaggatgggcccagggaactgtggggggtcctgaagtatgtgagccacacttggagcaggtgtgcagtaatccctgtggcgatggggcttgcagactggtgcaggaggcaggatgggttgggtaaacaggtgaatggctgggcagtggaagatggtaagagctgggaaagggcaggcccggcgtggccacacagggaagggcgttctgggcagagggagcagcatatggaggagccctgaggtgggtgcacctggggtcgctagggcgcggcagggcagagctggtggagtgggaagggcgcagtgtggagggcctgggaatgctggggcgtttagactgtggcccctcctctgagagggatggggactgctggagccctctgagcctttgcccaaaaggagcctcagctgtgaggcaactcagtccaagcagggtgaaagcaggaggcccagagtgggcagccgccaggaccaggagccacccacaggagacctgcacggaggccaccagggaaggcatccagagccgcgggggccgtgtctcctagacagcctcggcgtctgtggagatgggtacccgggcagtccagtgctggttattgagtgccttcgccctgccaggcccatctcggtgctgctcagcaaagtgggtgtctgagggaccgtcagccaggggtttttaggcagagagaatagctgcaccctgcctgccacaaaatccaccacatgtgggatctgggctttagatgtgcggtccaacaccctggtggcccaggggcatcttctctcagcccttactgcacaatcctcacccacaaaagggctgggggtgcaggggcccagccaggcttcgggcaagcatgcccctgtggagtttccccagggcagagggaggcccagctagtgggagtggggatggggccctgcctgtcagactctaagcataagggccgagggcacaaggcccaactggttcgtccttggcagtgttttagaggaaggctctcctggggccaccacagctgcttttcagccttgttcctcctcctctgtggcttgcaggatgggtgtgggatagcagagcaggggggtgtgtgtgtatgtgtgtgtgtgtcctgtcaaacataatcatagccggacactagtgaaagtagtcagacaggttttaatcggcaacataactgacatttgcaatggggaatagggtccaggctgagctgagctcaggttcaattggcacacaagtgactgggggtttccaagagagaatgagggagcagggaggcagcgagtgggggctcaggagagtgggggaagtgaaaagttacagatggtggaagcgggtggtccgtgtgaacacatctggacatgctgacgtgctcactgaagtcaggagacagtgtgtggctgtcctcaggtgtggctggaacccacagtcgattcttttggctgccgtgaggtttctcaggcaggcactttaaaggggactggggtcagcctagggatgccaccttgagctgttagaagctatgttagtggttgttcaagttgttataggcagaggtgaggcccagccaagaagagggctcagaggagccaggctggagtgtggtcgaggagagaactcttggtcagtgccacagctaagtgttgccaggagcacctgccacagcccagagagcccctggggtgcactcagagctccagcacctgccacgcagcacaccccatgcccctgggtccctgcaggcggaggccatgcagggaagaccccagggaaggctcctgtctctgattccacactacagcatattggtctgaagacagggactccaaagaggcctcagaggctgcagggggcccaagtcttgtggaaatgagatgtggggaaagttgggccttattgatgttgatgttgtggcctcagccagttccaatgctaaggcactgggaaaaaaatcttatgatttttggagcacatttaaaaataaggacaggttaggcacggtggctcatgctcgtaatcccagcacttggagagcctgaggccagcggatcacttgcactcaggagttcaagaccagcctgggcaacatagcaagaccccatctctacaaaaaaaaattagaaattggctgggcatggtggtatgtgccttggtcccagctattcgggaggctgaggtgggaggcttacttgagcctgggagctcaaggcttcggtgagctaggatcataccacggcactccagcctgggtggaagagcaagaccctgtctcaaaaaaataaggacaatttacataaacaatgttccaagtacctttcacacatcacattgggccccaacctgtgaggtggtgctgcagttgaggagcgtgcttttcagaggaacctgcagagggagaggtgaggacacgagcccagggtcttgacactgggatggggcaaatggggacacagtttttcctgaccctcccccgcccctgcccctgggaggccgcagtctaggtgggtgggccagggcaggagcgtggatatgagatggggggctgtgcttgggtggagaatcttcaagggagtgaaacagtccagcttcttcgtagatcagcgtctaaaaggacagcagggggaaatgccttttaaattttttttattaaaaaatgaaaaatttccagagttttgaaaaaattaaaaataaagataaatagaaattgtataaagtgggaaaatagcagcaaataacaataatttacaccgagggaagaagagaaagcacgacccagcagatggagattgtctgtgtggggctcacccactgtgctgtttccccaggtaccgcgtggtggtctcgtacccaccccagagtgaggcggagatcgagctgaaggaaggcgacatcgtctttgtgcacaagaagcgtgaggacggctggtacaaggggaccctgcagcggaacggccgcacaggcctcttcccgggcagcttcgtcgagagcttctgagaactggtgctccctgcacccagctcacagagggggaggccgcctgggaagctccacggcacacagagagggagccatggcgccccaagggttccaggtcatctccaaggcacctggcgggggataccctggcccagggtgggggccagggactgtggaggtcgtgccttctcccaaaacccccaaacggagagcacacctgggatgttcttcaaggaaatgcccaccccctctgtggaaactgcaaagaaagcaccttgaggaagagaggcaggtgccggcgcaggcaggcctgtggctgtggtttgcagccatggcagcgttctcatttaccacctaagcagggttggaggttgcaggaggtctgcaggcgaggtgggtggcatgggggccaggagcgctggagatcatctttctgggctgccctgggcttcccgcggggcccaggttgctctgtcaccattctatatacctcagtcacctgccgcccggctgctcagcaggggtgtttgtgaggccctgggggtgccccggaaggggcaccccaccgcccctgttgggaaccagagcagaatctgtgggcttgtcgcctgccagtagtataagcaacactttctgttcaccaccattgtcccttgcattacttctttcttacagcatatttttaacataaagctgttagactttatatatttctaataggtcagacattgcctatttttcatacatctggtgctgcctttttgtaaaactaataatgacttggttgagcttgaaagaaaagatgtctgaggcgacatcaaaggggcagaatttttatatttcccatatggctttgggagagcgccgagaagccgccatcccgcacctcagcgctggccagtactctgggggctggcggggtggatccattgagggggtcggagggagcttggaagcagccggtttctttaaactcttaccaaaaccccgcgctctgtctagacggtgatgattattattcaagacctggaaacatttcgaggaagggccactataattgtccttttgtgtggcggtagaaggagcacgcaggtcaaccccagccgggaaggcaaaatcttccctttattgcctcagagagaactgcaattagcattctcagaagatgatttcttggtatcaaaatgtgcagtttctacaacagtttagatcaccaccaccatttttcttcttttttaaaaataaataactgctcccatttcaggcagtgcaaaccttcatctgctggagaccagaggtacaaggagatcagggggttgcagcaccgctgcaggcttgcaagatcggggagttgggagggcgagagaggaggaggtgcagctttgatgctgggacctccctgagtggggctgatgaatgtatattcattagcaccatggctcacttcccaggaagactgatcaggagcccttcagggacaattttgttctcaagattcacaccttaggaacacatttttatcacctcaaaattttgatccatcacccctctctccacctatatttttacaaataccattcagacttaaattaagctgaagaaactagcctttggtaacatagggtgtcattggttttcagggatgtaaccaattccagaaatacattcttttgcctggcatgaagactttgaaacacgggccgcttattttcagagttcctgttttgggacgtgacttggctacttgttacttccaggtggttaccacacggcgggggtcatgcctttccctcccccaagatgataatagatttaatagactcaaagaagttgttcagaatcaaagaagaaaaagtctggcttaaacatagtaacttctgtgtgccaggttaatgacaaccaaaagctctctatttaccattattgccaaacttcatcagttgcccatcctgcaccaaaatcctgtgcgtgtttaaattcacgttgtcaccaaagaggtgcacagatcaacaacctggatgacgcaggtgttctccagggaaaccagaccaagtcaagtctccaggtaacttttttgaagtcttttttttaaggcgcgcaggtaccaagcaacagaatagagtaacctgaacgttcttactctcccaggcatggcccacgtggtgcttcaggtagaaatgtgcttcaccctcctggtggggggcgaggacacagcccactgcatgcagcatggtagagagctggggcgaatatctccatgtctttggaggatgtcagctggccgctttcagggcagagtcgggtgggcgttggtgccaccttaggaaggagagcgatgcgtgggtctggccagagctctggagccaatgccgggctgcctgagagcagaggaaatgcatggcccatgtgcatttctgagtattttaaactcgttcaggccctgcagccttcatgatgatgtagcttgcagagaagagcaggagcagaattagccctttcttcaggccatcttgcctcaaagggtacacatgtttggcggttaagatgaaactaacccttatgtttcatcctggccccatgatgtacacatcttagccatgtagtggccttggggggccacagagatttcctttgaggagcatggtagagtccacagccatggctgaagtcagtggacaccgaggggacaggactgcaggccaccaggggcctctgcccagagggaggcagagaggatggcggccacgggtgctctcctggcatcctcatggggtgatgccaggccgggcacttcaaaacaggctcagccgactgggagatcctttgtactttgcacagttcacacacacaaacacacacaccctatcccaagtgtttttgttagacacaaatgtcagcgtgtgattttggaagacttgtcagtgatgacaaaccatgatgcctgtgtttctgagtctttaaataaaaatgaacatgg

SEQ ID NO: 491 - DNA, 305425 bp, Homo sapiens
cggcggagcgcgggtccctctcctgagcatcagtgagcgcccggagccgtggccgctgggggttgcggcggcgctgagccagcggggccggtgagtactagccgcgccgccagcccgcccgccggccggctctttgcgcctcagccgcgtggtctgaagggatgggcgggcgagcgcgggggtccggcagtccgtcgtgggggcacgggactgcctttctgggaaggcgtgctgcgtcttcgccgcgggggccccggtcccctcgtcgcgtgtcctgtccccagcccaggagggacgtcctggcctgtcctgcccggcccggagcggtgggaccggtgccgcaggtggcagcggcaggtggccgcctcctcccctccgggcccgagggttgtcgcagggacccgggactgagagccaggtggctcccgacagctgcggccctggaggcgaccccagccctcgccgcagtgggacaggtgcgcgggcacgcccggccccggctcctgggtctcgggagcctcccgcaccctccctgttgtgccttgggggtgctgcgtggtgcagaggaccgagaagcccttcgccctcggcgtccgccgcgctcccgccccttcctggccggggtgacaggggaagggctagggctgcgcatcccgggtcagctggggcgccgcggcgcagtgcacctggaaggcccgggggcagcgcgcggtgcccgtgggtttcccggtggtgcggacctgcgggcgtgcggaagtaacgacctccttccccagtgcccatgcaaggaaattagtgttatgtgcttgctttttttttttttttttcctaaggaagtttgactctgaatatcttattttgctggagctccatttgccagcacgtaagtttatgtaataagcggcatacagttcggaaaaaaattttcctgtgaaagtgctcttccttgccctctgcaggaagaattacgccgagctggttggcaggcttatccaccagcaactgtaggagctgcaggcagcagataaagtgttttttgagtaagggcacaagtcagcccttcaggacaatttttgtttttggaagattctgttatccagttccaaacaccgtgttatttcagtgttgaagatgggggaggagggaggagcacaggcttgtcaatcctaatacctcaacagaaattagctttgcaggattaactctccaagcaagcgagttgaatttggtagcccaaactacagctgaagctgagcctccatactaaagcctgtctcagttttaatagtttttcgcttgattcgtttgcctcttccaagtaggtgatcttattgtctgttaaacaacagatgtctctcatgtttttacttttttccttgtcttccatagattactctcgctgcagtgttgactattgaggttaaataggaatctttgtcttgggcttggttttagggagcattccctctgtatcttcaccgagtgtattctatcacattaagtacatttctgtttatgcctaattactaagagtttaaaaagtcaagggtgggtgttgggttttttgcccaaatgcttttgtgtagcatgcattgatatgatcatgtagattttcgtcttaaaattgttaacataagtggtggtcacattgctagattttctttctctaaaaccctgggctaatttaaaatgcacttttggattgttcacatcaataagctagcatcttatttagggttttggtatctgagtttggcatatagtttaccccatttttatctgtgttcataacaaggatcaggctgtcctctctgattaaattgggaaactttccatcattttctatgctctggaatagaagaattatctgttccctcaagtttggcagaacttgactgcagactgcctgggctgctgctggtgttgtttaggcagttaatatcagtatttaattaccttttcatttttttcatgatcatttatttttctcagtttttctgtttcttcaaagtaaatttaatattttctgttttcctagaaaatcattaacattattgaaatttaatatatgctagcataatgttgtatatagtattctggtgtaagaaaacagactcttacatatctgtatgtatctgtatgttctctttctgatacagtactttttttggtaccttttctctttttttttgatcagacttgcttaatgattattttattaatcctttcaaagaaccagcttttattaaccaggatttattgattaattctattgattttttatttttctatgacattaatttctgttttttatctttctacttaatttgagtttattttgttcaagttttaactgtttgaatggaaaacctggctcatttatttaatcagtcctgtgaacaaggcaaggacttctaattctttcattccacttacctcacatttggccttaattgtatttttacttcaacccttccaacgagacattattgctattgtttttgttattttctaggtcaacatttattagctttatctacctgtttaccatttcttcactttccattccttcttgtatcacagatacttttctttggaacatttttcttctccctcaagtacattctttagaaattacttcagcaatgatcaattttctgtttttgtaatatctgaaaatgcctttattctccctgtattctagaattttggtttcaccatgtgtcttctattgatttcagagttatttttgtatttttttatatttttaaaaagatgttttgtagctggaaggtttttaggatctctattctgccacagtgctgaaagaaaaacaaagattaagaacagattaatttgcagtccactgtcagtcacgactgttccctgaactcttagtatattgggtatacagttctatattaatctcaagtttattgatggtaattcaggttttctgcatccttaacttattttttttctctgtttgacctgttgatatggagagttgtattgaagactcccattatgattcttgtaggggtttttgtactatttctatgtttaatatatatttttctttaaatgttgtatttttgaagctgttttatgtgcttaaaggttcacaattcttgtatcttcttggtgaattgtaccttttgggaataaacgagccatcttatttaattttttttttgttcattctctttatattgctgtacttgctttttgttagcatttatatggaatatctttttctagtcactgattttcaattttctgtgtcttctttaattgttactcttaccattagcttatggctggattttgtttaattagttaatctttgtcttttaataaatattgtggtaaaataacataaaatttattatttattatttttatttttaccatttactacttttaagtttacagttccccagtgttaagtgtgtgcacattgttatgcaaccaatctccagaattttttcatcttacaaaattgaagctctgtatccattaccgcagcccctggcaaccaccattctgctttttgtctctatgaatttgcctattttaggtaccttgcatgagtatctaatatagtacctcatatagtatttgtctttttataactggcttatttcatttaatgtaatgccctcaaggttcatccatgttgtagcatgtgtcagaattttcttcatttttattgctaattaatattccattgaatgtatacaccacattttgcttatccatatatttatcaaaggatatttatgttggttccacatcatagctattatgaataatgctgccatgatcatgggtgtacaaatatctcttcaagaccctgctttcagttatttgggtatatacccagaagtagaattgttggatcaagtagtacttctatttttaattttttgatgacccagcatagtgttttccgcagaggctgaaccattttatattctcaccagcaatgcgtgagaatttcagtttccatacatccttgctaacatctgttattctctctctttttttgatagtagctatccttatgggtgtgaaatctttgtcttttaataggtagctttagcccatttatatttattttgattactgatcttttgcggattattcctgtcatcttattttatatttttgatttccttttttgagacggagtcttgctctatcgtccaggctggagtgcagtggcacgatctccgctcactgcgacctccggctttcgggttcaaacgattctcccaacccagcctcccgagtagctggaattacaggcctgcaaccactatgcccggctaatttttgtgtttttagtggggacaggttttaaccgtgttggccaggctagtctcaaatttctgacctcaagtgatctgcctgccttacccgcccaaagtgctgagattacaggcatgaaccactgtgccgagctggttcatttcattctcattgctgtgtatatgccattgtatatatccctaatatagatatacatttgactttgattggcagttggttgtttgcatttttggactattatgaatagtaagtacatgaacactctagtacacgtcttttgttgagtgagtgtgtgcatttctgttgagtgtgtatctgggagtggaactgcttggttgtagtctgtgcatgtgctcggttttagtagatactagcaaacagttttcagtaccggttgcaccaacttatttaccccagaagtatatgtggttgctccacattcttgccaactcttggtaatttctgtcttttaccttttagttattctggtggatactgtggttttaatttggattttcctgatgataaatgaatttgcactgttttggtacccttagtttttcacacatatctaaacatttttttctcttgctattaaaagataatctgtttatgtgaactctccatgagtaaagcaaaaaagaatcttatcatgattttaattctgtcccatattaaatttttgggttttcatacattatgcataaacagttatttaggtaaactgtaaatttttctgattatttactcatcattggtgcttttatttcatttgttttcttaatgagtccttaagtgattatttggttttgttttcagggattctgtgaatggtaaactttctgaacccttgcatgtttaaacaatgttttttatttcacttttccatgtgaatattcttgactgggtataggattctacgttaaaaccttctgaattttggagatattgctttatctgctggtatctaggaagaagtgcacgcgtctgactctcgtttctttgtagttaatgtttattttctctgaagctttacaattttttttctttctccttggtgttctaaaatttaactattatttgtctaggagtggattttttttttgagatggaatcttgctctgtcacccaggctgggagtgtggcatgatctcggctcactacaacctccacctcctggtttcaagtgattctcctgccttagcctcccaagtagttgggattacagatgtgcaccaccatacccagctaatgtttgtatttttagtacagacagggtttcaccatgttggcctgactgatctcaaactcctgacctcaggtgatccacctgcctcggcctcccaaagtgctgggattacaggcatgagccactgcgcttgggcaccacactggcttaagagtggatctcttttgttcttcctgctcagcatttggtagtccgtttcattctaaagattaatacacatttctatggcactggagaagttttgagtgtttccttgcctctattctattttctgcttctggaattattcttacttgggaattagaatatcttgatttatctttcatgtttcttgaaataagcatttttttctctcaaatattctgtcttttttaatttaattttttttttttttgagacagagtattgctgtgttgcccaggcctggagtgcaatggtgtggttcaatgtgacctgcaactcttggactcaggcaattcccctgccataccactgtgcccagcggaaatgctctctttatctttatgggctgcattctgggatgttccttgggctggttttgcaggtcaccaatctaatatttagatttgttccgtcaactctttagcccatctcttgagtgtttttaaatattgattatcatatttttaactttccgggtctctattttttttttttttttttgaggtggagtctcgctctgtcgcccaggctggaaggcaatggcactatctcggctcactgcaagctctgcctcccaggttcacgccattctcctgcctcagcctccccagtagcgaggactgccggtgcccaccaccacgcccggctaattttttgtatttttagtagcgacggggtttcactgtgttaaccaggatgatctcgatctcctgacctcgtgatccgcccgcctcggcctcccaaagtgctggggttacaggcgtgagccaccacgcctggccacgggtttctacttcttaaagtttaacttttgaaataggtaagataggcagggcgcagtggctcacgtctgtaatcccagcactttgggaggccgaggcggatggatcacgaggtcaggagattgagaccatctggctaacatggtgaaactccgcttctactaaaaaaaaaataaaataaaaaattagctgggcgtggtggcgattgcctgtagtcccagctactcaggaggttgaggcaggagaatggtgtgaacccgggaggcggagcttgcagtgagccaggatggcaccactgcactccagtctgggcgacagagagcgactccatctcaaaaaaaaaaaaaaaaaataggtaagataatcagtgttcaaaaccagactgtattaaaaaggcataaatgaaagtgagaggtgacagcgtgctggcagtcctcgctcgctctcggtgcctcctcagccttagtgcccactctggccgcgcttgaggagcccttcagcccaccgctgcactgtgggagcccctttctgggctggccaaggctggagccagctccctcagctttgcagggaggtgtggagggagaggcgcgggcgggaaccggggctgtacgcggtgcttgcgggccagcgtgagttcccggtgggcgtgggcttggcgggccccgcactgggagcggccggccagccggccccaacggccccaggcagtgaggggcttagcacctgggccagcagctgctgtgcccgatttctcgctgggccttagctgcctccctgcggggcagcgctcatgacctgcggcccgccatgcctgagccacccccacctcctgggctcctgtgcggcccgagcctccctgacagcaccaccccctgctccacggcgcccagtcccatcgaccaccagagggctgaggagtgcgggcgcagggcgcgggactggcaggcagctccacctgtggcactgatgccggatccactgggtgaagccagctgggctcctgagtctggtggggacttgagaacctttatgtctagctaagggattgtaaatacaccagtcagcaccctgtgtctagctcagggattgtaaacgcaccaatcagcactctgtcaaaatggaccaatcagctctctgaaaaatggaccaatcggttctctgtaaaatggagcagtcggctctctgtaaaatggaccaatcagcaggatatgggtgtggccagataagagaataaaagcaggctgcccgagccaagagtggtaacgtgctgcggtcgcattccgcgctgctgaaggtttgtccttttgatgtttggaatgcgttcttattactgctcactctttgggtctgcactgtctatatgagctgcaacacacacctcgaaggtctgcagcttcactcctgaagctagcgagaccacgaactcaccaggaggaacgaacaactctagatgcgcccccttaagagctgtaacactcgccgcgaaggtctgcagcttcactcctgagtcagcgagactacgaacccaccagaaggaagaaactccgaacacatccaaacatcagaaggaacaaactccagacacaccgcctttaagaactgttacgctcaccgcgagggtccacggcttcattctccaagtcagaccaagaacccaccaattccggacacaaaaggtgttcccaccattcctgtcctcttacttctctcgccttacaagtaggtaaccattgttgttagttacttatgtaccttccaaagtttcttcatgcaaatacaagcaaatatgaatcagattctccatttctccttttttgcacaaatagtagcattattctctatctggtcttcatcctgtgtttttatttcttggtatatcacaaagatcgtcacataccaactgcttgctctttataatgtccccttaggtcttcccaagaatatctaataatttcttctatgtgctctagtaattatctttgcttgggtttgtgttctgttgattcagtgtccctgtttcatcatactgaataaaaacttggtgattctttatgtgttcatcttcgaagtttgagaattccttttttcctgtcttactaggcgtagcgtgcctcctgtgattgttgaagagctgtggtgtgctgctgagtggcgtgtgtattccatgtgaggggaagggtccaacagtcctggtcattcagactgcagttccccaggtaatcaccttgtcaggttctacctctgctgttctatctgctgttacaagtctgttcctggaaacctgttaccatttccttctgcataacagcctcctcccaagcttgtattgggctatggtttgctcaggtaatctggttctgagtactttttacttttcagaaatttcctagacattttagttggccatcggcactcttgttttccaggtttcttttgatttagtgttttaaaaatgtttctaccattccattgaattttaagacacttggaaggcagaagtatgtgtttagtttattgttttggggacagggtcttgctctgtctcccaggttagagtgcattggcgcagtcataggtcactgtaactttgaacttttgggcttaactggtcctcctgcctcggcctcccaaagcgctgagattaccggcatgggccaccatgcccagtccttggtcttttataatttatttctgtgttgggggcccccaggaccatgctcagatctggtggttcacttggaagactcagcatgtggtgtactcacggctgtaatttattacagtgaaaggatacaaagcacaatcagcaaagggaaaggtgcatggggccaagtccaaaggaagccaggcacaagcttccaagcatcctctcccagtgcagtcacacaggatgtatgtgcttaactccccgaggaaggagctgtgacaacgcatgtgaaatgctgtctaccagggaaactcactagagacccaacacccagggtttttattgggggctggtcatgcaggccccctttgcccagcacataccacattccacgctacctgaagaaaagcaggagttcagcataaaccacacaataatttaggcacagtgagtccctctttccaggttggatggtgggaacccttctgaaatctaagttcccaggtgccagccaaggattaaccatgctttttatgagactttttaagaataacagtcttgggccaagcacaatggctcatgtctataatcccaacactgtgggagaccaaggtgggaggatctcttgaagccaggaatttgagactagcctggccaatacagaagaccctatcattcatttatttatttatttatttatttatttatttatttatttatttatttatttattttaaaaagcagtcttaggcctgctgtgttaactcttttctgtaagattttcctcctgtgttcctcagaaaaagatggacactttacctagaaatgacttctcccagtcagatggtcatgaatttttttgccttctctgaagagagaacacatttgtattaaggtgaaactgagtggagaacatttcctgatgttggagaaagccatagcatggcacgtgctcagcagccttgagagggtgtcagtgagagagcacagagggactactcaaccattcaaaattattttgaaaaggcaaggatccttttgaactttatctgcaaattccatgaggtgagaagtttagctcaatatagctggaaagttgagattgggttctgtgctgatagcaggaatgacacgaaagagctgaataaaaaatccacacatggtctttaattagccatatacagatggtagtggcccatcatccagctcagagatctgccacttctcttccagctttcccacggagccaccctgatcacccccatccatgttggtctttcttccccaaatggccatcagctctgctcacagggcctttcatcactggcttctttgtcactggcttcttttccgtggttttattggatagtttttgttgcctcattgtgtataatcttccacaagattgggaattccttgaggaatgaacagtaagtcatagttatataccccatgtctccctgcagggtgacatgcatagagctggtgcctattaatgttttcggaaagaaccactagaaggaagtaagaagcagccttttcttcattctagtcactgcttcacatgcagctgatttttattctgtgttgagggtggtgatataaaacaccacgctgacattacctgtttgagttgtctgagttctgtctgcagcagatggtgtaattaaatgttttagtttgaaaggcttttcaatttcattcaatctgagtgtgggcttagattgtcaaatcatcttttctaactctaaaggctgtatctagtcagcctggatctagtttcctccctttctctgtttttttattttttttatttttttgagacagagtcttactctgtcacccaggctggagtgcaatggtgtgatctcggctccctgcaacctccgcctcctgggttcaagtgattctcctgcctcagcctccagagtagctaactacaggcatgtgccaccacacctgggtaattcttgtattttttgtagagatgggctttcactgtgttggccaggctgatctcaaactcctaatcttgtgatccgcccgcctcagcctcccaaagtgctgggattacaggcgtgagcctccacgcctggccctccctttccttggttttagacctcaggtgtgaggaattgaattaattatattctcattcttagccctttatcatcactggcccatgcaagcccctctgttgttttgcttgttaatgcatttgttggtttatttgttcattccgttttatcccactctcattctcttctccctatagacagctattctaatgaggttcatataatacttttgtgtatatacagttgacccgtgaacaatgagggggtcaggggaactgattgcctgcacagttgaaaatctgtgtataacttttgactcccaaaacttaactactgacagcctactgttgagtggaagccttacccataatataaacagtcaattaacatttattttgcgtgtgatgtgtattatgtaccatattcttagaataatgtaagctagagataaagaaaatcataaggaagagaaaatatacttttcattagttccttggaattggattatcataaaagtcttcatccttgtcatcttcatgttgagtaggctgagggggaggaggaagaagaggggttggtcttgctgtcttgggggtagcagaagtggaagaaaatccacatgtaagtggacacaggcagttcaaacctgtgctattcaagggtcacgcgtatactgctttgtgtgcatctatttttaatttacatgaatggcatcatgttctagcctttattctgtatcttaggattgtcactcaccacccatctctgttacttggtgattctggtcttaatatccaccacattttgtccatctcgtctcctgtagatggacacccaggttgattcccactcccagtaatgctgaatgagcctcgtacatgtctccttatggacttgtgtgagaattctttgggatttagacccaggagtaggactgcctggtcgtggtgtgtgcctatacttaatataaccaagtactgccagattgctgtcaagggtggctgcaccactaccttccccagcagcacacaaggattcccaaggctctgatatatatatatataatataataatatatatatatatatatatttttttgtacttttagtagagaccgggtttcactgtgtcggccaggatggtcttgatctcttgacctcatgatccgcccgccttggcctcccaaagtggtgggattacaggcgtgagccactgcacccggccatcccaaggccctgatctttgcatgcgcttggcatcattcaactttctagactttagcagtctctctctttttatttatttactatttattattattataattataattattattatattttttgagatggagtttcactcagtcgcccaggctggagtgcagtggcatggtctcggctcactgcaatctccgcctcctgggttcatgccattctcctgcctcaacctcctgagtagctgggactactggtgcccaccactacgcctggctaattttttgtgttttcagtagagacggggtttcaccatgttagccaggatggtctcgatctcctgacttcatgatccgcccgcctcggcctcccaaagtgctgggattacaggtgtgagccactgtgcccggcagcagtttccctctttttatttgcatctgtctgtttactactgaatttgagaatgcttttatatatgcttgttatctttttgagtttccattgacataagttgcctgttcatgtcctttccccatgtttcaactggaatccaatatagactattttagacattagccccttgttgatgtttcgacagtgcacatagtttctcctaatatgttatacgtcagctttttggttggtatctgtgttggataagaatccttaattctataacctgaatagtcaatctgccccatgaacttacttagttttaccttttgacatgtctgttgacaacatttagtaatcaagatatttcacataaaaatccagattcctagtctctcttgaaagggtgaaaagtatttcagtcctggctagagtgactgaggggtgagctcctgctgttgctagggcctgggctgcctacccacctgtcctcactcattctcttgacctcctggccactagtgtcatttgactttatgaccagccactgctgtatgtgaggcaataccttaaggataaacaagcatggtgatgatgttcccaagattgcttggacatggttatggagtgggtggactcggcattgagaacacagtagtagctgctgcatctcatgacactattggatgggtgtcagcatggcagcagaatactgacggactgtgtgcacattctttcagcagtaatgattcattcttttcaaccttttctggatcggctcattcctttttgccaaaaaaaaccaaacaaacccaaaaaactatggtttagtgaaattgcatatgaacaagagttctaaacgagggatctgaaaactttttctgtgaagagctatagagtaaatattttaggctttgcagggccgtgtgttcccttggaactacttagctctgctcctgtagtgtgaaagctgctataggttgtatgtaaatgaacatggtctcttcatttggtctggatttgggctgcagactgtagtttctgatccatgttctaaaccatagtcttaagacttaattttgtcttccttctcttgtttttaaggtgcaaggttatacataacattttgctaatgaatacatggtaagtacctactaggtactaggtgctgagattatagtgatggacaagacacaaatccagtctattcagcttaatgtctgggtggggagacagatgagggagcaggcaattactaaagaggatggcaggccaggacacgggagagcacacaattgggcagcaggggttgggagcagggcatgtcaggtaagacgttctagaagaaggtgatgtctaaatgaagggggaagagggcgaggcaggataatgcaaaggtccttttgaacttcatctgcaaattccatggggtgagagtatagctggaaagctgagattgggttctgtgctgatagcaggaatgacaagaaagactctgaataaaaaatccacacgtggaatcgtgaatgcttaaataatccaaggttgatggtggtaactcctatgctattcaaatgtggcagaaaataaaaaaaaaaaacatggaaagcatctcagctgattttacaaagttaaaataaccctgatagagagcagtatatggatactgggggttggaaattttaaaaaaatgaaaaaaagaacagtataagcccgtagatgtaaactatagaccaaatttacgtgtgatgtgtatacaaatatcctaaatagcaaaaggaggtcagcagaatattaaaagagcaatacactttgacgaaatatattttactctaggaattccagaatcgtttgctattaggacatatgttagtttaatacaaggggaaagtttagtaagtttccattttatttaataaaatggggtagctatataatcgtcttgagagattctggaaaagcacttagaatttgacttcaaatcttgtcatttcttgaaacgttttcatgcattgtgccttcaggttgtacagcgtggctgagtttaccactttttaatttctctggcaaatctttgctgattatagcttttcattcatcacgtcctttgtgaatccattcttgtttactctatgcggaataaatttttctcttctcttctagtccagtaattctccattctttcatttcaattggagttttcagtttctctcaattgctttccttttttgagagacagattaggcactggagatacaaagataaataagatagtactcagggttttttctctttatcctctgattcattttctacccttccatatttctctgtctcagagggagatgattcctacaaacttcattttgcagtgttccttgtcactgtctctggccaagtatggctagtaggaagcactagtgggagattgaaaggtgggaggaagggagaagtcagggtttttcccccttgttttctgctttgcacagtgtctctagggtggtcccagctccagccaaggactctgacactggcttgtggactctgataatagcccctcctttatccttccagcttcatgggtggtaggtagatggggtcccactgttgctaatctctgggttggctcaccatcccaactggctttttagtcctgccctaaaccttgtaattagttcccatattaaattcctgctattgaactgcttctcttgaattctatttttcttattaaactttgcacaatgtagataaaaaccctacttctgtgtgttcacaatctcataggaaaagcggacattaaaatgactataagtttagcctagtcagtgttccctcttcccttcttttggaagtagacttcactttgtgcatagcaattggccatgacccagaatgagccaatcaaaatttggacatgggcacacacagagaaaagatgatgtgaagacgcagggagaagatggccacctgccagccaaggagagaggcctgggacagagccttgcctcagggccctcagaaagaaccagctctgctgacaccttgatctcagagtcctagtctccagaactgtgaggaaatcaatttctatgtttaagctccccagtttgtggtactttgttccagtagttctgggaaagtagtgtactacctgtcctcccagccccacccaaccactaatctactttctgtctctatagatttccctattctggtcatttccgatgcatggaatcataatctgtggtcatttgtgactggcttctttcacttagcataaggtttccgagattcatccttgtagcatgtagctggatgtcactccttgtatgggcagataatattctagtgtatggataataccgcatgttatttacctgttcatcagatgatgggcatatgggttcttaccacctttgctgttatgaataatgttgctataaatgcccatgtacaagtttttatgtggatatatgttttcatttttttggttatagacccaggaggaatattcctgggtcatacggtaactctgtatttaataatttgaggagctgccagactgttttccaaagtggctgcatcactttacattcccaacagcagcgaatgaggtttctgattttttcacatccttaccaacatttgttattacctttttattctagccatcctagtgcatatgaagtggtgtctacattctacattgtggttttgatttatatttccctgatgactagtgatgttgagcatcttttcgtgtctttattggccaattgtatatagtctttagataagtgtatattcaaggcttttacccatttttgaattgggttgttttgttgttgttcttgagttgtaggagttctttatatattataaatattaaatatttatcagatatatataatttgcagatattttatttcttccattatgtgggttgtcttaattttcttttttttcctttttttgttgacgtaataattatacatatttatgaggtacagagtgataatttgatacatgtatgcaatgtgtaatgattgaatcagggtaattaggatatccatcatcacaaacatttatcattcctttgtgctgggaacatccaaaatctcttctagctttttgaacatgtacaataagttattggtaactatactcgccctacagttctatagaacactaaaacttattcttcttacatagctgtaaatttttatccattaacttttcccaagcctccccttctaattctgtgaccccattttctttttagcacccatgtctgagtgagaacatgtactgtttatctttttgtgctttacttatttcattaaatataatgtcctccaggttcatccatgttgctgggatgacaggatttcattcttctttaatggctgaatagtattctattgagtgtatatgccacattttctttatccattcatctgttgatgcacatttagatttattccctgtcttggctgttgtgaacagtgttgcaattaacatgagagtgcatatatttcttcagtatactgacttctttcctttggataaatacccagtagtagggttgctggatcatatggtagttctattttcagttttttgaaaaacctcagtattattttccataatggccattaccaatttgcatccctacccacagtgtataggagttcccctttctccaaatctttgccagcatccattatattttgtctttttgatagtagccattctaactggagtgagaggatatctcatagtggtcttgatttttatttctctgatgattagtgatggtgagcattttttcatacttgttggctattttatacttgcaaggctcccagaatagccaaaacaaacttgaaaaacaagaacaaagtgtaggatgactcacacttcccaatttaaaaatttatacactaacaagtaatcaagacagtgtggtactggcagaatgatagtgacatttgtatgtcttcctttgagaatgtttattcagatcttttgcccatataaaaaccagattatttgcttttttgctgttgagttgttttagtcacttgtgtgttctggatactagtcccttgatggatggatagtttgcaaatattttctcccattctacaggttgtcttttcattctgttgtttcctttgctgtgcaggagctttttagtttaataaagtgctatttttccatttttgtttttgttgcctgtgtttttgaggttttagccataagatctttgcctggaccaatgtcctgaagcgtttttccttatgttttctaccagtagttttatagttttgggtcttacattcaagtctttaattcagtctgagttgatttttctatatggtgagagataggggtctagttttattcttctgcatatcgatatccagttttcctagtatcatttattgaaggggtgtcattgtcaaaaatcagttgactataaatatgtggatttatttttgggttctttattctgttccattggtctatgtgtctgtttttctactagtaccatgctgttttggttactgttgctttgaagtcaggtagtatgatgcctccagctttgttctttttgcttaatattgccttggctattttggctttccatttcttgatggtgtcctttccagcacaaaggtttttcattttggtaggtacaatttaccctattttaccttagttggtcatgcttttggtgtcatgtctaagaattctttgtcaaacctaacgtctttaagatttacccgtatgtttccttctaagagttttacagtcgtaactcttacgtttaagtcatcaattcatttttgaattaatttttgcatatggtgtgatggagggtccaacttcattttttttttcatgtgactatctgattatcccagacctatttgttgaaaagaatggtcttgttgacctttttgaaaatcatttgggctggatgtggtggctgatgcctataatcgcagcactttagtgtgatggagggtccaacttcattttttttttcatgtgactatctgatcatcccagacctatttgttgaaaagaatggtcttgttgacttttttgaaaatcatctgggctggatgtggtggctcatgccagttatcccagcactttgggaggccacagtgggaggattgcttgagcccagaagttgaagaccagcctgggcaacatggtgagattctatctctacaaaaaagaaaaaaaaaaagaaaaaaatagaaaagcacttaccatagatgtttaggcttgtttctgtactctcaattatattccattgatatgtatgtatgtatgtgtcttttgccagtaccacacagtcttgattactgttgctgtgtcgtaacatttgcaattggcaagtgagtcatcctatattttgttcgtgtttttcaagtttgttttggctattctcaaggtcttgcaattccatgtgaattttagaataatcttttcaatttcaacagtgaagtcatctgggatttttttttttttttttttgagatggaattttgctcttgttgcccaggctggagtgcaatggcacgatcttggctcactgcaacctctgcctcctgggttcaagcgattctcctgcctcagcttcccgagtagctgggattataggcatgtgccaccacgcctgactaattttgtatttttagaagagatagggtttctccatgttggtcaggctgatctcgagctcccgacctcaggtaatctgcgtgcctcagcctcccaaagtgctgggattacaggcatgaaccgccacccccagcctcatctgggattttgataaggattttgttgaatttatagatcaatttggagagcattgccagtaataagtcttttgatccatgaacatgggatagtttttcatttatgtaaacctttaatttcttttaacagtgttttgtagcttctagagtataagttttgcacttacttgaataaatttatttttgagtgtttttattctttttgatgttattgtaaattgaattattttcttaatctcatttttgggttgttcactgcaagtgtatagaaatataatagatttttgtatattggttttctatcctgcagccttgctgaacttgtttatcagttatcatagtgtcttagtagttcccttaggattttctaaagatcgtatcgcctgtaaatagagatctgttcttttttttggaggagtttgtgaagaactgatgttaatttatatttataagtttgaaagaatttcacagtgaaatcttctgggcctgggattttctttgtggatagtttcttggttgtcaattcagtctcttcccttgttatagctcattcaaattgtctctttcttcttgagtaaattttggtagttgatgttgtcctaggaacctgtccatttcatctaagttttctaatttgttggcacacatttgttcgtagtattcttttctaatccctcattagtaatgtcccctcttttatttctgattctagtaatttgagtcttacctcctttttgtcagtctagttaaaaggtttgttaacttggttgatcttttcaaagaactagcttttggttttatttatttttttccatttttctccttttgatttcattattttttgccataatctttattattttcttctttctggttgctaggaatgatatagctacaagccaaggagcacttagggttactgagaaccactggaagctggaagagacaagggaggattctttcctagagccttcacagggagcatggccctgtactcaccttgattgcaggtgtttagcctccagaactgggagaaaatacatttaagttgtgttaagccactcaatttgtggtagtttgttactgtaccctgaggaaactaatacaaacattttaattattttatttatttttttactgtatttatgtgagttactttttagtatctagggtttaacatgtgtgtcttaacttaccagaatatacttcatatttataatttaattctagttagataccaaaatgttattcctatgtagttctattgtcttcttccctttttgtggtatttttgtattatgtctattaatattacaaacccaaccatattattgttgtaattattatttttaaattttttaaaattttatttttaagttccctgttatattactttactatctgtagtaatttctttagcctagtaacagctttgttccaactctcttttgtgcagttatttgcaaatatattacaagtatatttctatatatgttataggttcaacaataggctttatatataatattttatgcaattgctttttaaatcatttcagagaagaaaggaaaaaatatgcattgttagtgtcatagttacagaataacctttactgctatgcttcaattttctgtgagaattcagattaccctctggggtcacttgttttcagcctgaagaacttcctgtggtgtttcttctaaggcaacaaattctctacttttgtttctctgggatgtctttatttcaccttcatttcctgccccccagcccttttttttgtggtaagatacatataaaatttaccattttaatcattaaacattttttgaaaagttttgtgctctcatgagccttggtcctgcacatctttctcctcctcagcagcaatctcgtttcctgcttaattattttttggttttgctttttgtttttgtttttgttttttcgagacagaatcttgctctgtcgcccaggctggaattcagtggcgcgatctcgactcactgcaatctctgcctcctgggttcaagcaattctcgtgtctcagtctcaccagtagctgggattataagtatatgccaccatgcctggctaatttttgtatttttagcagagacagggttttgccatgttggccaggctggtctcaaactcctggtctcaagtgatcgcctgcctcggcctcccaaagtgctggcattataggtgtgagccaccgtgcctggcctcctgcttaatcatttttaaattttttttattttttattttttgagacggagttttgctcttattgcccaggctagagtgcggtggcgcaatctcagctcactgcaacctccgccttctggtttcaagcaattctgctgcctcagcctcccaagtagctgggattacaggtgcccgccaccacacccagctaatttttttgtatttttagtagagacggggtttcaccatgttaatcatttttaagtatactgttcagtagtataaagtatatttgtattgttgtaccaccctcaccaccatctgtctccagaactctttttatcttgcaaaactgaaattctgtacccattcaacaataactccacgttactccctccctcagcccttggcaaccactgttttactttctatctctgaatttgactaccctaggtatttcatacaagtgaagtaatatggtatttgtccttttgtggctggcttatttcacttagcatagtgttctcaaggtttagccatgttgtagcatgtgtcagaatttcattcctttttaatactgaataaattccattgtgtatacatataccacattttatttatttgtcgatggacccttgggttgcttctaccttttggctattgtgaataatgctgctatgaacatggatgtacaaataactcttcaagaccctggtttcaatccttttggatgtatatttttgaaagacagctttgtcgtatataggaatctttattttttttctttgagcacttcaaatatgttatcattcattgtttctgatgagaggtcaactgtttctattattgtggttcttttataagtgatgttcttttgtaagtgaggttctcttataagttttcctctagctgctttcaatattttctctgtttttgacttacagcatttttaccatggtgtatctgtttgtggttctttttgtatttatcctacttggaattcattgagtttcttgattgtataggttattgctttaaaacaaaaatctaggaagttactggccatcatttgaatattttttcttcctctttctcatctgcttccggtactctcagtatgcatatgttaatgtgattaatggtgtgccacattttgctgagattctgtttatttttcttcattcttttttctttttatttttcatttgaataatgtctattgaagtatatttgtctcactaaatttttcttctgccagttcaaatatagtgttgaaccttctctagtgaattttaaattttagttattctacctttcaactccggaatttccattgtattatattttataatttctatgcctttattgatattctctatttggagtaatattgttatgatactttcctttccttttttaatcacgcttttctttaattctgtggacatatttataatggttactccaaagtctttttctgttaaatctgataactgtttgctctcacttgcagtttcccttgtctacttcccccgtgataccccatcctatcataaccacagaaagtatggttcatacttccttgtttcttttcatgcttcatatatatatgtgtgtctgtatatatgtatatatgtgtatgtgtatatacacacacgcgcgcacacacacacacacacatatatatatgtatattttttttttttttgaggtggagtctcactttgttgcccaggctggagttcagtggcgtgatctcggctcactgcaacctctgcctcctgggttcaagtgattccctgcctcagcctcccgagtagctgggattacaggcatccaccaccatgcctggctaatttttgtatttttagtagagacggggttttgccatattggccaggctggtctcgaactcctgacctagggtgatctgcccgcctcagcatcccaaagtgctgggattacagacataagctaccatgtccggcctgtatatatatattttttggttggaaactggacttttcagatactgtattgtaggaactctgggtattggcttcccacttctggagcctcttgttcttatttgtttagtgactgcatagattattttaatgaagttgatttccccctgtcttggttcatttgtcttgctataaaggaatacctgaggctggataatttataaagaaaaaaggtttattgggctcatggttttgtaggctgtacaagaagcatggcatcactatctgcttctggcgagggcttcaggctgcttccactcattgcataaagggaaggggaaccagtgagatcacatggtgagagaggaagcgagagatgggggaaagtgccaggctgtttttaataaccagttgttgtgggaactaagagtaagaactcactcattcctgcaagaatggcaccaaaccattcaggagggatatgccacccccatgactcagacaccttccaataaggccccacctccagtactggggaacaaatttcaacatgagactcggtggggccaaacaaaccatatccaaaccattaacaccctaacagggttaaaccccttatgttgctcctcaaggaggtacagctttgggtgtgcttattgtcagcctcaaatgacagtgatattgatagggctctcttcctaaacagttagcaaatttaacagctgttgaactccactaattgttagctggttgctctatttaacaatgccatggagcataaaaattgctctaaatactaatacaattaaattctggctcctttaaatagtttctaaagtaagcgtttgatattcttttttttttttttcttttgagacggagtctcgctctgtcacccaaggctggagtgcagtggcacaatctcggctcactgcaacttccacctcccaggttcaagtgattctcctgcctcagcctcctcagtagctgggattacaggcatgcaccatgacacccggctaattttttatatttttggtagagacggggtttcaccatgttggccaggctggtctcgaactcctgaccgtgtgatccacctgccccggcctcccaaagtgctgggattacaggtgtgagccactgcgtcaggtctttcccccaattttttactaaaaaaatgtcaaacctacagaaaagttgaaagaataatacagtgaattcccatatacctttcatctagttgaccaaagtgctggaattacaggcatgagccaccacgactggccttatagatcttagtttggcatcaagtgtaagaattctttacctcgccttacatcccaaagattttctatttttcctttttttttttttttttgagttggagttttgctcttgttgcccaggctggagtgcaatggtgtgatcttggctcaccgcaacctctgccccccgggttcaagcgattctcatgcctcagcctcccaagtagctgggattacaggcatgtgccaccacgtccagctaattttgtatttttagtagagatggggcttctccatgttgatccggctggtctcaaactcctgaccttaggtgatccacctgccttggcctcccaaagtgctgggattacgagcgtgagccaccgtgcgtggcctttttctaaatgttttatagatgtatatcttatgtttagtccttgagtcattttgagttaatttttctgtagggtgtgaggttcaggttcatctttttgcctatagatgtgcaatgactctacaccctttaatgagagacatatcttcccccgttgaagtgttttaacacctttgtcagaaatcatttgggcatatttgtgtgtgcttctttcttagttctctatttggttgcattgatctatagctgtccctctgtcaatatcacagtcttgattactgtagctatgtaagtcttgaaactggatagactgattcttcccactttatttttctttttcaaatttgttttagctactctagttcctttgcatatttccgtatacatttttgtatgatcttgtctatatctatgtaaaatttttctgggattttggtagtaataatgttatcctgtgtaataatttggataaaattggcatctttactatattaagttttccaacctataagcatggtatatttcacgctatttaagtcttctttgatttcttttatcagcgttttgtagttttcagcacacaagtcctgcacattttgttagatttatatgtaagtatttcatttttttcaggcaattaaaaacagtatttattatgtttttaattttagtacccatgtgcttattgctagtacatagagatacaatttttttttttttaaatagagatgtggtctcattatgctgctcaggctggagcacagcagctattcacaggcacaatcattgtgcattacagcctcaaactactgacctaaaacaatcctcctttgtccagctcaattgatttttgtatgttcatcatatatcctgaatcctaaagacttactgaattcacttagtagttttagtgtttttaaaattaggttattttgctttttttttttgagacggagtctcgttctctcacccaggctggagtgcggtggctcaacactgcaacctctgcctccgggttcaagtgattctcctgcctcagcctcctgagtagctgagactacacatgcctggctaatttatatattttttagtagagatggggtttcaccatgttggtcaggctggtctcaaactcctgaccttgtgatctgcctgcctcggcctcccaaagtggtgggattacaggcatgagccactgcgcttggctgctttgcatttaagaaaagtcatgctttattttattttttttgagatggagtctcactctgtcaccaggctggaatgcagtggcacccagctcactgcaacctctgcctcccttgttcaagcaattctcgtgcctcagcctcccaagtagctgggtctacaggtgcacgccaccacatcctgctaatttttgtattattagtggagacgggatttcactatgttgaccattctggtctcaaactcccgacctcaagttttctgctcgcctcagcctcctaaaatgctgggattacaggtatgagccactgtgcctggccaaaatcatgtgtttttaaactgacagataaaattgtgtgtatttatcatgtacaacatgatgttttggagtaatatacgttgtgctaattaacgtatgcattacttcacatagttatcatttttgtggtgagaacgcttaacacccactcttttagtattttcaagaatacaatatattaagtatagttaccatgttgtgcaataggtatcttgaacttactcctcctaactgaaatttggtatcctttgaccagcgtgtctccactgcccccctacccctagttgctttacattttctatgagacaatcatgtcatctgcaaacaggaacagttttatttcttctttgccaatctgcaggtctttcatttccctttcttatcgttttgcacaagttagaacttcagggctatgttaaataagagcaatgagagtgaacatccttgctttgttcctgatcgtaggggaaagcatttagtttttcaccattaagtataggttagctgtaagcttttgtagtcttttgtaagctttatcaagtcaaggaatttcccctttattcttatttttcttattagagtatcatgaatggatattggattttggcaaatgcttttttctgcattgattgatgtgattatgtagttttcctctttagtacgttcatatagtgggttaccttgttttcaaatgttgaaccagacttgcgtttctggaataagtcccacttgatcatggtgtataattatttttatatattgcttctacttgctaatattttgttaaggagtttaaggagttttgtgtctatactcatgaaggatattggtctgcagtttatttttgtttttttttcctttttattttccccaccaccctgcctggctaatttttgtattttagtagagacagggttttaccatgttggccaggctagtctcaaactcctgacctcaggtgatccaccagcgtcagcctcccaaagtgctgagattacaggtgtgagccactgcacctggcccagttttctttttttatactgcccttgtccagtgcttcttttttttttttttctgactgttcctgcagagcagagctacccataggcagtgtgtcaagagtagctgtccttatacagttctagtatcagagtaacacccacttcataaaatgaactgggagatgttcccttctcttcagttttctcaaagatgctatgtagagttggtggtaattcttcattaaacatttggtagaattcttcagtgaaaccatctgggcccagatatttgcttcttgagagttaaaaacattttttaaatccttattcttcaaacaaagttctatttttctgaagatatttttcacagtacatacatctctttagctgcaaaataatttgtcgtttttatttgttaaggaagggtataattaccttatctaatatttataaaatattaagtttaatgtttctgttttaagagtgttaaaattacaaattcaattttctcagtagttatcaggctatcccaattatctatttcatattgggtgagttgtggtaatttgtgttttttcagtaattagtccatttcatctacattgtcaaatttataatgtgtagagttgtttctaattatgctttcattctaataactggtaatccgtgtcttctttcttttttgtttgttagccttgctagaggtttgtcaattttattaatctttcgaagaatcagtactttgtttcactgattttctttattgtgtttctgttttcaattttactgatttatttttatattttctttcttttgcttgctttgggtttattttgctcttcatcttctgtgttcttgagatgggagtggagactattgatttgaaactttttctcttttctaatgtaaacatttagtgttataaatttccctctcagcattgctttaactatgtcccacaaattttgatattcttttttttttttttttttttgaggcagtctctgtcgcccaggctggcgtgcagtggcacaatcttggctcactgcaacctctgctgcctgtgttcaagcgattctcctacctcagcctcccaagtagctgggaccacaggctcccgccactgcgcttggctactttttgtagttttttagttgagacggggtttcaccatcttggccaggctggtctcgaactcctgatcttgtgatccaccagcctcggcctcccaaagtgctgggatcacaggcgtgagccaccgcacccagccatattcatttttagtcagtttatttcccttaagaaatttttaaaaatacattaaacaataaaaatgaatatcagaaatgaatatctttgacccacggatgattttagaaatgtgctgtccagttttcaagtatttggaggcttttctcgttatcctccagttacctctttctagtttgattccagtagagcacactctgtatgacttctattctttgaaatgtgttaagtttttaaaaagcgttagatataatccacataccatatgtttcacccacttaaaacgtacaattcaatggccttttttatatttgtagagttgcgccaacatcaccacaatcaattttggaacattttcattatcccaaaaagaaatcctacactctttaactgtcaccttctccctccccatgcagctcttccactgtccatccaagccttcggcaatcactagtgagctttgttttatggcccagggtagggtctaaggatatgttcagtgaatacttgaaaagaatgtttattttgctattgttgggtagagtgttccgtaaatgtctattagatcctgttgttcagtggtgttaagttcttctcaactccatgctgatttttttgtctagttgttctatcagttgttaagagagggtgttgaatctccaagcagaatgattgatttgcctgcttttctttcaggatcttttcttgatccttttattcctgtctcttgaaattttcttttctctgaagtctattttatgttattaatatagccactcctttcttttgattaatgttttcatgatatattttattcttttaatttcaaccaacatatgttggtatatttaaagcaggtttcttttttgtttttcaactgaggtggagtctcactctgtcgttcaggctggagtggcgcaatcttggcccactgctacctctgctgcccgggttcaagcagttcttgtgtcgcagcctcctgagtagttgggactacaggcgtgtgccaccatgcctggctaatttttttgtatttttagtagagatggggtattaccatgttgtccaggctggtctggaactcctgacctcaggtgatccacccgccttggcctcccgaagtgctgggattacaagtgtgagtcactgcactcagcccaaagcaggtttcttatagctatgtttttaaattaactctgctatctctgtcttttaattgatataattagatcatttacatttatgtaattattgataagttagggcttaagtctaccattttatttatgtttttaaaaaatttagtttgtcctcctctttttttctctttttgtcttgtcttcctgtagagtatttgaatattttttagaattccatttcaatttatctaaattgtttttggttattatctctttgtatagtgttgttagtggttgctgtattacattatatgtatatatatatatacacacacatatacacacatatatttatatatacttacgtgtgtgtgtgtatgtaacttttcacagtgttgtcattttaccacttcaatgaggtatagaaacctatactttccccatttataattctctgcatacatttagtagaagcacttcagacagggttataatttttgcttcaaccatcaatataatttagaagtcttaagaggagatagaaattttattgtaattacatgtatttttgcttactatgttatttctttcttcttgatgtttctggattccttctttcatcattttttggtctgttgcatgatcttccttttgccattcctttaggggagatctgctggcaacatattctcttattttgctttatctgagactgtcttgatttcccattgattcttgaaggatatttttactgaatctagaattttgtgttgacacttcttttctttcagcacttgaaaaccattgtgtcatttccttctggcttccttaatttctgtaagaaatctgttacttgaattgtttttcccttatacatgaagtgttgtttcactcactgctttcaagacgttttctcttttcgtcttttcagaagtttgactatgatgtattttggtgtggattttattgggctttttatttggggttcagcatttcgaatctataggtttatgtctcttgccaaatttgggaagttttcagctattattttttgaatacgtttccagctgtgccatctttgtctctttcctggaccctgatgacaagtgttagatcttttattttagtctcagaggtctttgagactttctccctcactccttccctccctccttcccttccttccttcctttctctttttccatcattcctcctgctgctcctcttttttcttctttattttttggccagtctattttctttctgttcttcatattgggtaatttctattattttctgttgaagttcactgattattttgtctgccccctccattctatgttgtctttccattcaatttggttactgtatttttcaattctaaaatttccattaaaatatgtatctatttttttgagatggagttttgctcttgttgcccaggctggagtgcaatgtgcaatggcgggatctcggctcaccgcaacctccacctcctgagttcaagcgattctcctgcctcggcctcctgagtagctaggattacaggcatgtgccaccatgactggctaattttgtatttttagtagagacggggtttctccatgttggtcaggctggtctcaaactcctgacctcaggtgatccgcctgcctcagcctcccaaagtgcagggattacaggctgtgagccactgcacctggccaaaatatatatcttttatttctttgccaagatttttttttcatttgtttcaagcacgtttgtagttgtttgttgaggctttttttttttttttttttttttttgggacgaagtcttgctctgttgcccaggctggagtgcggtggtgcgatctcggctcactgctcctcttcccaggttcatgccattctcctgcctcaggctcccgagtagctgggactacaggtgcccaccaccatgccttgctatttttttttgtatttttagtagagacggggtttcaccgtgttagccaggatggtctcgatctcctgatcttgtgatccacctgcctcggcctcccaaagtgctggggttacaggcgtgagccaccgcgcccagcctgttgaggcttatgatatgtgctttaacatcctttcaggtagttctaatatctgtgctctcttagtgctagtgtctgtcaattgtcttttctctctttcagtttgggatcttcctgactcttggtataaatgatcctcaatgaaaacttcaacgatttgggtattacgttatcagactctagaccttatttaaacctgttttgaacaccattgtagtagaagaagggggacatcagcttgttacttctagatgggggtaaatatccaggctttccgctctgcttccattgacacccaatggggtgggggacccctgttgctgctgggtggttgtgggtattctggttccctacttggcctccctgatacctccctggctaggaggggtaggagtgcctactgcttgccacagtgctttcactgtcaccatgggggaagagggaggaaaggtggcctcattatctctgggaaaaggttaagtcactgaatctccactaggcctcctctgacatgaccccagcagggagggcctcatcactcctgggtgggagtggaagtccaggttcccctgacactgctggcgggtgagggatgggctccttactactgccatgcagggataaaagtcgcagtccttactcagccttggtgggggtgttgggtaccttggtacgtcctcacaagactggaagtctaggctccctgctcagttattgctggtaaatgggcagttactgtctaaatgtgttccatctcattagactgtctccttcctggtcctttggctagagagggcaggcttttcttggggcttttcaatctgtgccccttggtgttttgaagttgcctgctgcttcagctccaagtctgagataatgaagcaaaaagaagacccagtgaacccatcactgggttgttctgtgggcctcaaggcacctggatagtctgcctcctcttccccttccagaaccttcttatatttgttttatatctagtgttgagggtttttattaccacttactgggaagaacagggaaaagtatgtctgctctgtccctggagctcaagtccacaacttgcttttcgtttgtttttaaataattagttttgtttttaaatgaaactgagttttctttggagaggccaagcaagtttctttggagaggccaagcaagttgtctggtggagcgtctcatggtcagaagctgtccagttcttcccttgtgattagcttcaaacagttttggcgagaagctgtgtgggcgatgctgtgtagctcccacatcacaaggaggcacatagtgttgtggggcctggctgggggtcacaggaagcttgatcacatcttccttcctgtatctaataaattatctgtggtgtgaaactctgagatcatgtgagcatcctcttcccaagcagccttttactcagtggttttagcatgtctaggtgaatatattaaggtttacaaaatgataatttttctaattctctcatttcctttacatttattagctggtattcttccatgaagaagagctttatccaaagccacatccttttgttctctttttagtaccaatatgtattttaattcatgttttataattcattactgtcatgtttttcttgaaattgttccacgcggggcaaagtgagctccttctggttcactcttaggtccatttaacatgactctgttaatctttgggcagttccttgatttctgggcaacatgggatgtcccagactcaccattttcatttcatagtccacacctagaatcagctatttccccaaggagccctgcttccttttagtaaggaatggtatttagaaatgcaaataaatttccaagggagaagagttttctaagggaagataaagtattgaattatagtagttactcgtagtcacaactgctactgtattcttggtgacttaggccctcgtttgaagttagggaggtagagcttcatgtgacagtgatttgtgtgcctgtgtctcctctatctggctgactttcttgggagccaggagagtatcttttcaatttttatattcacagtatttagcactgtttctggaacagaggaggatttaataactatttggacttaaattgtgctaaacagactcctaagctgtgcatcatagaatccaagaatttttctaatgttctgcctgtgtggagaagagtaaggatcttctccacacagtggagaacatttctcacagtggaaatgttcataggccctgggcagattattcagtgtttcagaacttgtttctcttgctgaatgggaagcattttattggcttcagcatgctaaaaaaaaggctataacaagatctgaggctgttcttacgaggtagtggtaaagtatgggtatgggattcagtttgaacatttagagaaggtgactttgtaatctgtatatagctcaccctggaggtgaatggtactggttttcagcctctacttgggagatgtgtgtttcttcttttgctgactctgctactatatagttttatgacctttaagtcagtcagttgctcaatttcttttccttattttcatctggaaaagagcgtgatggtgttttgaattaagatataataagaaaaacatataaaacccttggatatgtagcaataaaatgaaagaagatgtattataagcacagaacttggccattatgagtagcaacaaaggaagcctagtgtcaggtcctagggtttgtttttatttgaaggagctgtatgtggcattttaataagggttccaaatgaaagggtagtttcaggctgagtctagctttgagactataatgataatgggactgtaaagttatattaaagtgggtttaggcagaaggcacatgaaaagtacatttatttataaccgcattttgagtgaagggatagaacctaaaaggaaagactaaaatattcaacatggtatttatcaagtaaagggtgtgctcacgcacatgcgtgcatgtgtgctgtgtgtgtttatgatgaataagaactcttttattccatcaccatttgtttaaacatgaagtttaaagaaatgctttatttcctgaattttctttttccaaaaagtaattcttgcttggggtaaaaattacaagcagtatagatatacaacttagtaaaacatctcaatattctgctgatagttttgtttctgttctttcagatgttttctgtgcacacactagatttttttttccagaaattagctcatactgactatcataagcccatcctgctgctgcttgagtttgttttcacgtaacacacagctttttatgtccatctgtggacatccatatcactctttttgatggttgaatgatgggtacataccctcatgtacccagtatcctattgagacatatggattatttcttgttttttgctattataaacaatgctgcagtaaataccattttgtgtgtgtatctgctgtctcatgtactttggattgatatctaagagtggaattactgaaacaaaagttgtggatatttatgttttgccagttgttctaaagagttggttaatttgcagggctgaggattcctcatctcagatgacataaggttcttgttatactctctaagtgccctgagtttctctctcacatatggtggctgtaatcagtgggcattacaggtgcctttgagatggtgtgacccttccagggacatctgtatcccacagaatgtctaagttggtacatcctagctctcagcacgttcctcctactgagcccagacttggcagggttggccaggtgtgtgcttatagtttgtggtttgagactgtggcagtttttcctgctttatctgagatgatgcttttctaccctgtttatcagtagtgttttttgggctgggggaggtcacaggtgaggtgatgcaaaataactcctactcttgttttcaactggaaactaatttatatcttattttgttgtatctggcttttcctccccctctgttaattggaagatatgcttatctttctcagtttatcgacttgagaaagaaatcttttggttatacctttctaaaaaaaaaaaaaaccattagcatagtaatattacttcacacttcctgtaccttaatctccagtttttgtgacgctttgagaattcttttttaaaaatttaagttttaatttttttagagacagtttcttgccgtgttgcctaggctgagtcttgaactctggtctcaagtgatccttccacctcagcctcctgagtagctgggattgcagatttgagccacagtgcctggcagagtttttgttattattatcaaattaatattatttttacattattaattttttctttctaggcttcttaaaattatatctaattttctatccatagttaacccagaccatgagatttaattctatttagatttaattctgtgcctaactggaactggtactactgctagttcattcattgataacattgaatactctgaactatgccctgttctatgtcctagggataaagaaatgaataaatagacagaaatccctgcccctctggagtttatgtactagagggggtggcaaacaatgtaataaatgagtaagtcttagaatacgttagaagagaacaagtgctaaattgtaagaataaaagtggaatagggtgagtgaggtccatggggtcaaggggagtatgtagaatttaaatagggtagtcagggagggccccattgagatgctgacatttgagcaatgacctagagtaggtaagggagttaactcactgcaggtggaggaggcggccagagccaagactcaaggagtcgccttcctgatgtacaggaggggcagtgaggaggccagggctgctagggtatgcaggagacacgtcacaaggatccggagggcacgtggggtggggggtgggaagggctttgtagaccagtgcgcactggagggctctgacttgggtgttgatgtggtcactctgctatgctgagagcagactccaggggacaagactgggaggagggaaaggtgctgactattgcaggaaagccgggcgagagatgttggtagatgggaccagactgatttgaagctatgaagttcccattaatgagcacattaagtacatttaactttcagtgggctggattaggactacatttttcttaaggattcttgagtatgagaatgcttgtgttctttcatgttgtaaatgcttgtgttctttcatgtctttcatggcttttgcagcctttaaataatgcgtgacattctaacttggtaaagatgtgttgggtcactttctctcccttctggctcagtaggcagcattcttttgtcttcagactccagtgttctggagaagactgcagatggtctgcctttttccgcattatgggtcacccacttctttctctgtgttggtagaatcaccagccttgctagatgtgtcttgtgctggttggactctactgatttttcttggcatatgctaaaccctttcaagctatagattcagttactcaatttcaggaaagttttccggtgttatatcttaaattttcttttcctgtgccatttgttttgttctgttcagaattagcagttgtgtgtctgttggatctttatctctcgtatctaacttttttttttgagatggagtctcactctgtcacccaggctggagtgcagtggcgtgatctcggctcactgcaagctccgtctcccaggttcatgccattctcctgcctcagtctcccgagtagttgggactacaggtgcctgccaccacgcctggctaattttttgtatttttagtagagatggggtttcaccgtgttagccaggatggtctcgatctcctgaccctgtggtccccccgcctcagcctctaacatctttttaatcacttttatggatttcctatattccatttccccaaatgaatgtccgctttcactgacttcttcagcaattccacttcacttcttacccttcttcacgtaatgttcatcagataatggtgttagtgcttttctccattggtgtccttgactcatccgttaccttccttcagtaaggagcagggcccacagggaaggatattccttgctttaacctctcactaagctgagataaatttgaatacggctcaagatctagagaaatgagtctttttttttttttttgagacagagtcttgctctgtcacccaggctggagtgcagtggcgtgatctcggctcactgcaagctccgcttcctgggttcacgccattctcctgcctcagcttcccaagtagctgggactacaggcacctgccaccacgcccggctaattttttgtatttttagtagagactgggtttcactgtgttagccagtatggtctcaatctcctgacctcgtgatctgtccgcctcggcctcccaaagtgctgggattacaggtgtgagccactgcgcccagccgagaagtgagtcttgattcttgtcatcttccctcgattttgttcagcaaattcctgtctcagaaatagcctttgtgtttgttgctcagggttgaggcccttctctactttcattataggttgaatttccttctctgttttgactttaatagaaggggagagtagatattttttcttttgtaagaattcccagggccaggcgcggtggctcacgcctgtaatcccagcactttggagcctgaggtgggtggattgcttgagcctaggagtttgacattagcctgggcaacatagtgagaccctgtatatacaaaaattagcatgatggcacgtgcctgtagtcccagctactcaggaggctgaggtgggaggattgcttgaacccaggaggtcgaggctgcagtcagctgagatcataccatggcattccagcctggatgacagagtgagaccctgtctcagaaaagaaaaaaaaaaattcccagacatatcgcttaaaaattatcttttgtgaaaaataatatattacagtatataaaattcaacatgtttaacggggaaggagggaaaagaagattatcttctgcccctgtcccttagctcccagttcccagccccaggaagcacaaccatatagaacacattcctagagtggaattgctttgtcaaaggatatatgcacttgtacatttgatagacgctgccagattgctttccatagaagccatcagtatatatatgctatcagcaaaaaatgagagtgccagtctcctcacattctcaccaacatgatgatgtttgaagtttttcaaatttttgccattctaataggtaaaatagatttgaaagttttattttgcatttcctgttaatacaggtggttgaggagccaggtgcggtggggcacacctgtagtcctggtactatcatttgagcccaggagtttgagcctaacctgggcaacatcgtgagaccctgtctctcaaaaaataaataagtaaaagtcagtctgagcatcttatgtgccgaagagccatttgtattctctgtgaactacctgttcattacctgtcacatttttattttgggttagtggtggtttttttgttgggtttatataggtactctttatgtgtaggaaaattaactctgtctggatatgagtcaagttttgttttcccagttcattcagctatgattatttagctgtgtttgtgctatgttttaggcatgtagaaagatttggtttgtatgtaggtgattttctcttttataacttcagggtttttatattataggcattccccatcctaagagtccgaggattctacggtgttttcttctgctaattatactattttcatttttttcttttctttctttatttttatttatttattaatttttttgagttgaagttttgctcttgttgcccaggctggagtgcaatatctcagctcaccgcaacctgtgcctcccagattaaagctattctcctgcctcagcctcccaagtagctgggattacaggcatgtgccaccatgcctggctaattttgtatttttagtagagatggggtttctccatgttgctcaggctggtctcgaactcccgacctcaggtgatctgcccaccttggcctcccaaagtgctgggattacaggtgtgagccaccgcccctggccaatttttttcttttaaatatttggtgctcctcaccaacatggcacatgtatacctatgtaataaacctgcatgttgtgcacacgtaccctagaacttaaaactataattaaaataaataaatatttggtgctccttcagttactcctggtgttaggagtaaggtagggtgcccaactgtgtttttcctgatgcctatcctgctgtctgaacaccatttgttggttcctttggaatactagatttatcgtatattaaattcctgtatatgtttgaacctaattcttggtctagtccatgtctgtttgtctattcatgtaccaatatcaaaccttttaaaatttaggcttaaaatattttttaaaatgcaaattcaataaaatcattttggagagaagtcttattggaatatttcagtagttccttcacagtaagatgttgtagatcattcttctgagcacaatctgctattcattgttagggcatgtgtttagttacctactttgaattgattttgctgaaagaagtaaggattcttgggtggtctttctatattctcctaccctggctccttggtaatgtggaaaatgaattttcaggtaaaattgtcagaggacagtaggatggtttttgttctggagtatattaacatgaactggcccaacttaggctcacatttgataacttcatgttagtaagcatcctcctttggttaaataaactggctgtggatattctccagggaaaaagttactagtaactcttagaaaactaatgcatacatgagctggtaaagaggaacttcttaaagcacaattttagagttatagaagcatatatttgttgttatgatcttgcaagtttgctaactgctttactgaaaatagcgtgcatggaaaaacatagcatagtaggtcccaaataagcacttggttctttctttctttctttctttttctttctttctttctttctttctttctttctttctttctttctttctttctttctttctttctttctttccttctttccttctttccttctttccttctttccttctttctttccttctccttcagacagagtcttgctttgttactcaggctggagtgcagtggtgcaatcttggcccactgcaacctctgcctcctgggttcaagcaattctcctgactcagcctcctgagtagctggggttacagggacctgccaccatgcctggataatttctgtatttttagtagagacaggtttcaccatgttggccaggctggtcttgaactcttgacctcaagtgatctgcctgcctcggcctcccagagtgctaggattacaggtgtgagccactgtgcccagctagcacttggttatttctttaaaaaatcaaatttaaattctgtcctgaatttgttatatgctttcttttaaaatgtatgtttaggtaaacatctgttttagggctttttcttcctttgaatttttttcctttatttgttcattcaacaaatattaattacttgctctgtgctagacagcgttttaggtactgatattcagcagacaaggatcttgcttttattgagtttataatctagtgggggagatcagcaataaataagttgtcaggatgtgattagttttatggagaaaatcaagtagggtggggtgaaagtgactcactttgggggcagcatccagtagcattagttaccttttattagaaaggcagcatgggaaaatagaagcatggacttcagagtttgatacgttcctgtacaaatctcagattttctacatgcaggttgtgtggccctgagcaaattacctaacctctctgacccccatttccccaactgtccaaaggggagagaagaatacctgactcatagtgggttattaaggattaaatgtgacaacttcaacaaaaaaaccctagaagaatgtttgacctgtaatagtcactttataaatagcagctaaaatattatcacttcatcactttattcattaaaagtttttaagaagtttctccattatttcattagtttcaatatcatgtgcctagtaagatggtaggttttaacaaaagcacccttaaatagccatttgtgccaaatgtcaccatagtgactgctaaaatgggggaaccgcaggtattactgtattcatttccatgaattgtcatagtttaatgttcatctacagttggtcatgttttgttgaggtcctaacagaaaaggaactacatttgtattgaacattgtattagaacaaattttaatacctctgaaaggtcatacatcaaagaatctagaccaaaaaccagagttctagctcagaaacaccagcactaccactgttttatctgtcccacattgaggaatatgacagactctggttcaaagataccttaacgccttatccatactactagaggcccaggctgagattctcctagaccacaggctgggagcagtgacatctccaagataccaagtctgtcagggtcactgatggagatttccatagaggaggttctcaggcctaactgaaggcatcacttcttagatacgtggcccaatcaaacactatccaaggaaggagcatggactctagagaggtttgggaacagggtagcagatatgccagaatgctgaaacctggaacaggccaggaagacaaaacagcagtctgcatgtagcaaaaagagaaggtaggaaggtacaggtaacaacaaaatggatttgaggtgagaatctcaatgtgaggtcacatctatattcctaacacacacagtttgttacctatgcgtttgccctagagacaggaccacactaaatagcacccattctttcttattttccttatccctcaaacaaagaagtgtccctctcttggccccaagtcaatgggtaagggattctgccaagacctttgtcaactatcccctatcatttatgttttttacctctccctgtctactgatttattctccctctacctcaaaacatgcttatatggttcctttctttaaaaaagaattccaccgaaatttcctactctgacctctaactcaatagttaaagttcctttcatggctcacttttcagggggaatctgactccacttcttttacctttcaattcctccttaattctgtgatcttcctctattcttgctaaagtcatgaccatctatgggtatgttcattgcctgttggacatttgaatgtctcaggcatttcaagttcagcattaattgaaccccctatccacttccacagtgtgatgatttttaaatatatccacaaattctttgacacttcttatttcaagaggtggagcttagttccctttctaactaatggaataaggcagaagtgagagtgttaggagtaggtccatagtgttaggagtaggagtaggaagaacactgtggcttcctccttgctctctctctcagatcactcatgctgagagaagccaactgccagatggggaggatgttccagcaatgctatagagaggctcacttggcaatgaattgagatctcctgccaacaaccagcactgccttgtcaggcaggtgagtgaactccttggaagtggaccctccggccccagttgagccttcagatgatgcaaccccagctgacatcttgattgcaacctcttgagaaactctgagccagaaccagccagctaagcctatcttagattcctggcccacagaaactgggagataagcctttgtgttttaagctgctaaatggttgtcagtgattggctacacaccagtatataaccaatacacacggcaaaccttccgtattcccagtcgtagggaaagcaaggaaacaactccttcctctccaagatacaactggtgatcaagtcctgttattttcatctaggtatctgttgattcagcctgttctgatttttctagtcactctgtcagtttattatttatcatctagactgtttcagttgcctcttaacaagtttcttgcctccagcttcactctcttttaatctattccccatactgccataaaaaatcattctaaaatgtgaatttgagcatctttcttctttgattgaattgtccccattgactagagttaatcaagcccagtcatcttaagcaatgcaggcaaagctgtttgaggtttcatcccaccatgctttccagctcctgtctctcctgcagcagggtgttcagccatcaaaaatagccggtgggtcccagaatctcccacggcttttcttctttctgtgatttggtgtgtgcagttctctctagttttggaaggctttcaccaactgtttgacgctttctctattttctgaaagttaggcattcctcctttcttctgcagtccccaggggatacctgtgtaattgctgtgatcacatcactgtcattgtttgtctctcaatgtctgtttttcagttagaccaagaatcccactagatgagggtcgatgctctgttcatctcttttttgttgttgttcttgcgtatctgatcttttaaaatgtttgatattctttttctttttttggggggggtggtgtcttgctctgtcatctgggctggagtacagtggtgcaatcatggctcactgcagccttgacctcctgggctcaagcaagcctcccacctcagcctccctaggagtgcacctccacagctggctaatttttgtattttctgtagagacagggtttcaccatgttacccaggctagtctcgaactcctgggcttgatattctttttttattttactgtggtaagaacacttaaccacatttgtggatctactacatttgttaatctacccttaacaaatttttaagtgtacaatacattattgttgactctaggtacagtgttgtacagctgatcttgagagcttattcatcttacttaactgcaacgttatgttcgttgattagtaactcctcgtttcccgccctgcagctccaggtaacctccattgtactctttgattctatgaatttgtctatttttggtatctcatataagtggagtcgtgcagtatttgtctttctatgactgccttatttcattagcaaaatgtcctcaagattcatccatgctgttgcatgttatagaatttccttttttttttttagaggctgaatagtactccatggtatgtatataccacatattgtctaccccttcatccactgatgggcatttagttgtttccacatcttggttttactctttgaggaacctgcatactcttttccacagcagctgctccattttacattctcataaacagtgcacaaaagttccagtttctctacatcctcaccaatacttgctgtcttttgattttttggtaatagtcatcctgacaatgtgcgttctgttcattttaagtctctagcaactaatgggatatttgaacagggtgtctgaaacttttagtctagcagatagggaatttcacattagcagagtcagaatataaaaatgtaactttacctctctatacatgatcataacttcactctctagccattgtttttcactaaaggcagtgaagagtctttggggatgagggttctggccccgtcactgatgctttcattggccatgaaggctttgctggttgttggtgccatccatttctctgtgttcccttttctctttatgttagtcccactgggccccctccgttctgactgtgagagttctccaggcttgcaggcttgtgctcagctgtttcagtgcctctctggagcatgcaccttgggaagtgctatgtgggtctcagacccaccctcctggtgcaggggcctgcttagggctgagcctctttaggaggactgcactctgggaagaaccaatgatgtgtctgggatttctgttagctagatctctcataaattccaagtcttagtttgggatggaaagaggtagaggatctggacttttcagagacttagtagcatctttaaaagaaaaatacttagttcttccagtggaaagctgtgggttccaagagatatctgctgtgcatttatgggcctattttagagcagaataccaaaatattcaccataattttaaaaataaatattaaataattaaaaaattggtacagcctgccaggagctcagtgtgcaatggtgacatccagcctgtgaggccacctggtgcggcttgggaacccgcagaagcctgcactgaagcccagcaaacccctcatcctagctaaccgcagcaaggactggcgtccggagaagggcgaggccgcttgtatcatggagtgtcagcttgctggaagccgaatgaattccgcgatgatatgtgcagaaaagagatccagggctttttcgattgtgcttcaagggattaggaagcctaaaaaatgagatcaatacaggagaccctgggagagtctgggagtttacctcccaataaatagagtaagttgtcatagaggtttcctaagacacctcacctaagcttaaaatggaaaagcattttcaatgatttctggactatagcttctgacaattatgcagaggcattttatagatgtttgcattgctgtgacctctttgaaggataagatgaggaaaaacactttttctaacctttggaatcaatagtatgggtagaagttatgttttatcttgaaataaaatcctctgaagagaaaaaaataattaaaaaattaattatacttgttttatatttataggagagatcttattgttggtgatctttgatagtatctatagcccaggacaaatttccagagcccttccatttctttccttattctgtttccattgaaatagaaagccgaaaccagaattagaggtcatcaggaatgatgatgagtgtttttgctctaactgatcaatctggatatgcattcagattaaatatggatgtagagattctagtgaaatttttttactgaaggccactttcagcattctttcagctgctgagttaacaagcatatcaaactaaaaaacagaaaggttggccgggtgcggtggctcatgcctgtaatcccagcactttgggaggccgaggcaggtggatcacgaggtcaggagatcaagaccatcctggctaacacggtgaaaccccatctctactaaaaatgcaaaaaagtagccgggcgtggtggcgggcgcctatagtcccagctactcgggaggctgaggcaggagaatggcgtgaacccgggaggcagagcttgcagtgagccaagatcacgccactgcactccagcctgggcaacagagtgagactccatctcaaaacaaacaaacaacaacaacaacagcaaaaaacaggaaggttaagtgttttttgtttgtttttgtttttgagacagggtctctctctgtcactcaggctgtggcgcagcatgaccacggctcactgcagtcttgatctcctgggctcaagcagtcctcctacttcagcttccagagtagctgggattacaagcatctgccaccatgcctggttaatttttttttttttttgtagagacagagttttgctatgttgctcaggctggtcttgagctcctggcctcaagcaatccacctgccttggcctcccaaagtgctgagattacagatgtgagccaccacacccagtccaagtgtttctatttagttgataatggtgagtagattcctaatccactctttgattgcatttgattctggaaaatgtttctttatatcattttgcagcatttcagtgtagtttttaaatatgccaatcatgtatcaaaaaatatatttctttaatttgtgaagaaaactgtcaactctcggggaagtcaaactcgtggagatttagctgcctacattgcagtttggtcatatcatcaaggtatcataacagcattaaaaaatcatggtattttggttaagattcaggctgttccagataatgattactgaaatatactacttgagtgaatcacctgagatcacagaaatggtctttatcagccttatcaaagtcatgaagaaacagttttttcctcattttaaatattcttcattttaaatatccttgcgagcacctttctccttagtatcacatgtatttcagtatggaaaagcagaccctgggactcactgtccatactgcatgttgaaaagcctgattgtccatgactgtagtgcgacttaaaatgtttatccagctgggtacagtggctcatgcttgtaatcccagcactttgggaggccaaggaaggaggatcacttgagtccaggagtttgagggaggatcacttgagcccagggtttgagaccagtctgggcaacatggtgagacccccatctctataaaaaatttaaaaattagctgggcatggtggtgcgtgcctgtagtcccagctactcaggaagtttaggtgggaggatcgctggggcctgggtgattgaggctacagtgagctgtgatcatgccaccgtactccagcctgggcaacaaagtgagaccgtgtatttaaaaaaaagtttattcattttttagcattgaatgaagattagattatttagattagcggtccccaacctttttggcaccagggactggttttgtgggagaatttttccgtgaactggggtggggggattgttttggaatgattcagccacattacatttattgttcactttatttcttttttttttttttttttttttgagacagagtatcgctctgtcgcccaggctggagtgcagtggcgtgatctcggcttacctcaagctctgcctcccaggttcacaccattctcctgcctcagcctctcgagtagctgggactacaggtgcccaccaccacacccggctaatttttttttgaatttttagtagacggggtttcaccgttttagccaggatggtctcgatctcctgacctcgtgatccgcctgccttggcctcccgaagtgctgggattacaggtgtgagccaccacgcctggcctattgtgcctttatttctattattattacattgtaatatagaatgaaataatgatacaactcactgtaatatagaatcaatgggagccctgaggttgttttcctgcaactagatgttcccatctcagggtgatggaagacagtgacagatcttccggcattagagtctcataaagagcggaaaacctacatcccttgcatgctcagttcacaatagggttcatggtcctatgagaatctaatgacatcactgatctgacgggaggtgaagcccaggtggtaatgctcgcttgcctattgctcacctcctgctgtgtggcccggttcctaacaggctatgaactgggggttggggacccctgatttagatcatcaactctgctctgaggaaaacagcagtgttgtagactggcatgaagtgcaacttcttctactctatgtagcaaccccttttctttctggtcctccttcactttagatccctgagacccttttccacattgtaccttggtcgttgtatatgaacatcaaacatgaaaggtgctagtgagatcccatctctatagaaaatttaaaaaattagctgggcatggtgggcctgtagtcccagctacttgggaggctaaggcaggaggatcccttgagcccaggagtttcaggttgcagtgagctctgatcgtgccactgcactccagcctgtgtgacagagcaagggcctgtctctaaaaacaaaacaaaacaaagcaaaacaaacatgagaagtgctgattcataccttgcaaagaggtttcattcggcagcaagttgaaattatctactggtttgtacatgagctagcacttcctcttccacatggcatgccattgatgttccttgatgtttagtgttatttgatagaggaatttgctaacaccttgttctcttttctctttgatgaaaatgtttatcattaactttggggctcttctaaagaatgttccattagtatgtgtttgtacctttttttttggcctctgaagagtgcagctttcaatgacgcctctatagttgtggtcttttccttttggtaatgaagtgcatcagttttgcactgagaaatgttattttgcccttgaggaataacttggttggtttactaaagagaccatcaaactttgaaagtgacatggaaagcttatgcggtttctacaactatttcagaagcttcataaatgctaaagcgtctgggctgggctcagtggctcatgtctgtaatcccaatgctttgggaagctgaggcaggaggtttgtttgaggccaggagttctagaccagcccgggtaacacagtgagactccgactctacaaaaaataaaaaaatttaaaaagaaacccacaaaaacaaaaaaacaatagaggactctgactttaggagcaaatgaatccagtgtctgataaattccaattttttaattattcaccattgtgctttctatgtgtacttcccttctttaactgcctgggtggtacatctcttgacatataggatatgtgtctttctggcttgcagtttagttccagtcaatagtgagcctcctaattgttcagagttgtatttatgccactcaccatgtgacttttatacttcatcaaatcattttgctctgtcaatccttctgaactgatgtgatggtacaaaatagaaaaagatggaaactgctaattttaacagatataaacataaacacgtacataaacaccagtgcatacatattacgaaaatatattgtgtaaaagcagtaacttgtaggactaagattaactactgtgttagtagtgcaagtatacatttcaaacttaatgattatataaagaatgaaacaggatatcagtgaccataatacctttaacatttcaaatttgtgaaatatatgtgaacaaaattgtttcatttatttctttgtttctttttgagacagagtctcactctgccacccaggctggagagcagtggcgcgatctcggctcactgcaacctccatctcccaggttcaagcaattctcctgcctcagcctcctgagtagctgggattacaggtgcccgccaccacgcccggctaatttttgtatttttagtagagacagtgtttcaccatgttggccagactggcctggaactcctgacctcaagtgacccactcacctcggcctcccaaagtgctgggattacaggtatgagccaccatacttggcccatttgtttcttttgaaataggaattcccagtgtagcttttgttgaacttccatgggcctctacatgtcctccatctgcaggttgtatgtacattgggctgtagccatttggtggcaaggaccatggtagaggccagtctgagagtgcacctggtagatccttaaagatgcaacctttgggaaccttgaacctttgattgctataaacaagtaaatcccctagttgatcatcactcaggaatcttggctaagcaaggcctatgaggaaattgatttcttgacagatacatttggaaggtctttaagttattctccttaccaatcacataaattttttaatgttttctataacttactgacttcagtcccatttttctttcatttattcaacaaatatgtattaagggcttgctgtgtgctaggcactctgaaagacaagacagcatttttgccctcttggaactaatgctttgtatatattattttctcctgtatcatatccagtttacactttgctacttacttttctatttttcctttttcttacctattatgtttcagatccataaactattttgtctatgtctttatttcaaattattttgtggccgggcacggtggctcacgtctgtaatcccagcagtttgggaggccgaggcgggtggattaggagatcaagaccatcctggctagcacggtgaaaccccgtctctgctaaaaaaatacaaaaaattagccaggcatggcggtgggcacctgtagtcccagctactcgagaggctgaggcaggagaatggcgtgaacctgggaggcagagcttgaggtaagccgagatcacgccactgcactccagcctgggtgacagagcaagactctgtcgtcaaaaaaaaaaaaaaaaaaattttgttctccagtctaaacataccgtaacagtcgtagcattaacctttgtgcattaaaacgcttaacatttccatccaaaaaatttcaggtatttttattttaaaattaaacaggttctccctctttcatccaggctgaagtgcagtggtgtgatcacggctcaccacagccttgaactcctgtgctcacgtgatcctcccacctcagcctcccaagtagttgggactacaggcatgtgccactgtgcctggctaatttttaaaaactttttttagagatggggccttgctatgatgcccaggctagtttcaaactcctgagctcaagtgatcctcctgcctcagcttcccaaagtgcttccccactggcatgagccaccataccaggtcaaaatttcacgtataacacaagaaatacattttttttttttttgagatgtagtctcaatctgtcacccaggctggagtgcactggtgggatctcggctcactgcaacctctgccacctgggttcaagtgagtctcctgcctcagcctcccgagtagcaaggattacaggtgcacgctaccatctcggctaatttttgtatttttagtggagacagggtttcgtcatgttggccaggctggtctcgaactcctgacctcaagtgatctgcccaccacagcctcctaaagtgctggaattacaggcataagccaccgtgcccagccaagaaacgcattcttataaaaagccaaatatatagatatagagtaaatatgaagtcactccttataattcccatcccaactgcctctcaagagccatgaaagagactattttctatatttttgctaatagtcttatctcttcttaaaatgttagtctgcaagatgggtttaaaaatacctcattgctttagctcatattggttgctattagatgggttaagcatcttttcttatgtttagcagtcatttggatttttgtgaattgccttttcatatcctttgccttttttctgttggactgtttgtttcttcttgagttaattttggtattctatgttttcctagaaaatgatctgctttgcctagtttacaaatccttatatgtaattacgttctctttcttgttcctaatttgggtaccttccttttttctttcttgattagatttgccagaggttctatcttgttagtcctttcaaagcatcagcttttcattttattaatcttcaaggtcatttaaaaaatgttttctgtttaattaattgccgtttttatctttattcattcttcatcctgctttctgtggactcagagaagacccgttcatgtagaggaaggtgggaacaaaggttcaaagatagttgtcgagggtcaggaaaacaattgttggcatcattctccttcacctcctcactcccaactgccatcacaaacacaggcagttcagaatccatcaagaaatgagtcaggaatcaggcagactgaatcagactatcagctttgttaataaggctgaagtagagagtagtgcttgacctaagatcacagtcaggctagtaacccttccctctgagttaaacttagccaacagaataaggcatttagaataaacgctttgagaggtttgaaaagaagacagttggaaatgaataaaacaatcacttagaggtgctgagggccaaatggcctcagggcagttcggtttttcagttctgtttggagacctagatcaggaacaaagaaaaatgagttggcagtctctggctggtggctgagtaagcagggccagagttggcagaaggaggtgatcttggggtttcagactagtcagtgaggcaagtgagaccagcagggcatggaaaaaaccacgaagagacaggagtcggggcttcagcttcttgtgagcatgcaaacccagctcggagggagtgtgatgctgggacagccaaaagaggagcagctgggggccagagaagggcattgcacatccagaaccctgatggcaggagagtcagagaacgggcacaccaccaagtgtgatgaaacttgtgggggattgacgatgagtcattcttcagactctctgggactcttgttctttccccaaattagtttaacatctgctttggaatcaaaagggtaactgcttttctctttctggctaattaaacaaatgcaaatgtatgcatagccttattgtatcctcacacagcctgggagggaagcacagtgtgggtggcaggtacatgacgctagaagcagagggtgtttagtgctggggtgggaggacagcaggaggatctgtcccagcgccagacgtcttccatccctacgggacctctcaaggtcatgctacatgaccttcggcatatgaattcacctggcaccacagtattgttcttaaaactgaaaatgtaccagcgtattgtaacttgtaagcccacaaacttcttgtttctagccatgtacttacagaaagcccttgcctttatgttttcacagggagggcatgatgaaccttgtcttatagctcatgagaaggccaacttcactaaccactccttgccgggtgtggtatgtttccctctgtaattacttctccctgtgtactttcttatggtaaaatgtcatgcttcagaacaaaattaaaaagtcatctaaagagatggtttggttatcatggaagtcaagttcctcttagtagaaatgagcagttatagtcagactttatagatactagaaagaagagcaatgtatttctaaactacatgcttgtgtcaaatttcagattttgtttaacaatttgtatattaatcatgatctaacccacctgttttggaagaaccctctcaaactgggtttttcctctgctctcacaccacaacaacagtcatcaacacggaaaaagacttctgtgaccaaatgtatgggggtttctctatagaagtagtggacaccagctaggtgttctccagttcaactctgacgctgtctacctggagagagcatcagatcccacagggcaaaactcaggccccaaggctgcctccttctccagtcaccagtctcaagtctgggcctctggaacttctgaccaactggcttcaagttggggttcccatgactcctctgggttcaactaatttgctggagcagctcacaaaactcagggcaacactaacttacattgatcagtttattataaaggatatcgcaaaggatacagatgaagagaagtgtaggacaaaggatggggaagggcatagagcttccacgccttccctgggtgcactaccctccagaaacttccaggtgttcagctgtccagacgctctctgaactgtgaccttttgggtttttatggaggcttcattgcataggcaccacaaccatgtagaaatgtgattggacaaaaagtacatgatctaaacctagcatgcctgtctcttcaagacttttcttggtctctctgtgtaacattccttcctttagggtatagttaggactctctctagtttgagggactcctgacccataattagagaagggtcctgtcttgggcacgtgaaaggacaggagaagttcagagagagagagagattctgtttcctgaggcctaaagtgccctgaaattataagaaggactataggcatcaggagccaggaaccggttctaatgcccatagtccttgttataatttgttatctatatctatctatctatatgtatatctatatctgtatctatatctatctatcagtcaatcataacaacataccatcagataaacaatttctatccatacccattttctgataataaaaactggatctgttgctggctaggtgaaactcggaaactcatgaagctttttaccttttttacaaatgggagtgtgccctttcatcctgaatcattagagtctcctaggtacccctctctgaggactcttattctaacagcctttgcaaaaattagccaaacatctgtttgaaactcactcagagtcattttcatctttgcctttctcctagttatttttagggttgataaatttgttttccaagagcaaacagagcatttttaagctttgatttttggctagcatttaggaattcttgttctgtgcagagctggctggatgcccacttaggaacttagcctgcacggagattccttcagtggaagagcattggtctggagtcatccatccggctcctggagcttggctaccctgatacttcccggtctccctgcaaatgaacacctcagcatgccattatagttggtcatcttactctgtttttacagaatccaggaggagagttcctgcaaaggatgtcttgggcagggtttaattatttctacgaataagaaagctttcctcaggtggaattgtatttactttctgcaatataagccatgaatttacaaatagagtctgatactgtcaggatacataattgttgttatgcttaagtagttttttttttcttgagatagagttttgcccaggctggaatgcagtggcacagtcactgctcactgtaccttcaacctcctgggctcaagcagttctcccatctcagcctcccaagtagctgggtctataggtgccataccaccacacctggctaatcaaattttttttttttttttttttggtagagataagggcttttatgttgcccaggcgggtcttgaactcttggatgcaagtaatcttcccgccttggcctgccaaagtgctgagattctaggtgtgagccactatgcccagccttaaatagattttaaaaaattacaaaactgttacatgttcatagtagacagtgtagaaaaatgtaaaaagcataaagaaaattaaaatttcctatcattccaccacctagataaccattctttcttttttcttttttttggagatgtagattccaatgatgtcatctcactgaaacctccgcctcccaggttcaagtgatcctcctgcctcagcctcccaagtagctgggactacaggtgcacaccaccacgcccagctgatttttgtatttagtagagacaggatttcaccatgttagccagactggtcttgaactcctgacctaaggtgatccatgcgcctcggcctcccaaagtgctgggatttcaggcgtgaactaccacgcccaacctaaccattcttaatatatagatttttttttcagtctttttatatgcctaaatgtaaatatgagctcctactgcatacactttacaatttgtattttccaccaaaatatattgtcgtcattgttccatatcactggatattttgtagtatcactttctctattgagatgccataaattcacatatatttacatttatataaatgtttacatatttataatatttttaacatttatagtatatatcatatttctatagagataacatgtattcacttatattcactgccataaaattcatacttttaaaagtgaacaatatggtgatttgtttgtatcttcacaaagttatacaatagttggcactgtcaaattctagaacattacccccccgccccgaaaacccagggcagttaccacccttccatcgctccttccctcatcctgtggcagccactcaagtactttctgtttgtgtgaattcccctcttctggacattgcgtagaagtggaattatacaatagatggtcttctgtgtgtggcttctcttttttttttgagacaggttcttgctctgtcacccaggctggagtgcagtgctgcaatctcagctcactgcaacctctgccatcctcccacctcagcctcccaagtagctgggaccacagatgtacaccaccacccctggtttgtatttttggtagagacaggatttcgccatgttggcccaggctggtttcaaacttctgggctcaagtgacctgcctgcttcagcctcccaaagtgctgggattataggtatgagctaccatgcccagcctgtgtggctccttttgttcaacataaggttttcagggttcatccatgtatcggtacattattcctttttactgatggataatatttcactgtgtggatgtacactttatatttatccattcaacagctgatggccactgggttttttctactttatggctactgtgattagtgctattgtgaacatttgtctgcaggttcttgtttgaacttctgttttcaattcttttggatatataccaaggactggagttactgggtcataatggtaactgggtgtaactttttgagggactccccaaactgtttttcacagtggctgtactttttcacatttacgtaggcaatgtatgagggttccagtgtcaccacatcctcaccagcacttgttaatgtctgttcttttggctagagccatcccagtcgatgtggagtggcatctcccagtggctttggtttgcataatgcctaatgattgatttttctaatgtggagcttcttttcacgtgcttgttggccacttgtattgtatagtctatttggagaaatacctgttcagatcctttacccacttttcagttgggttatttgtctttttattattgagttttcagagatctttacacattctagatactagacacttatcatatataggatttgcaaatgatttctcccattctgtgggttatcttttcattttcttttttttaacttattttaggttcaggggtacatgtgaaggtttatcacataggtaaactcatgtcacaggggtttgttatacagattatttcatcacccaggaagtaagcccagtacccaacagttaccttttctgctccctcctccaagcctccaccctcaagtgtctgttgtttcctcctttgtgtttatgagttctcatcatttagctctcgctaataagtgagaacatgcagtattcggttttctgttcctgcattagctggaggctgaggataatgacctccagctccatccatgtccctataaaggacgtgatcttgttcttttttatggctgcatgtcctttcattttcttgatagtatcttttgaagcaaaaggtttttaatttttatgaagtccactttatctagtttgtctttgcttacttctgcttttgatgtcatctctaagaaaatactgtctaatatagtcatgaagttttacagctatattttcttccaagaattacaaagttttagctcttgtactttgaggtgatttttgtgtatagtatgaggtaggagtctaactttgttcttttatatgtggatatccagttattccagcataatttgttgaaaagactgtctcccattgaattgtcctagcatccttgttgaaaatcaactgcccataaatttatgggttcatttctggactgtcaattctattccattggtctatatgactgtcttacatggacatgggatgtctgtttatttacttgacttctttagttttttcaatgacattttgtagttttcagtgtgtagactttccacttactcatacatattgataaatattttataattaacatttataaatattttatagttaaacataaatattttattctttttgatactactataaatgtaattggtttctgagtatatttggattattcactgcaagtatatagcaatacaattgatttttgtaagatcttgtattctgcagccttcctgaactcctttattagccctaagaggtttttttgttgtaaattccttatgattttatacatataagagcatgtcatctgtgattagagatagttttactttcttaccaatctggatgcattttctttctttttcttgcctaattgtccagactaaaacctctggtataatgttgacaagaagtggtgagagcagagagacacccttgtctagtttctgatcttaggagaaagctatcagattttcacgtaaagtacaatgttagtttgtgagtgttttgaacttgccctttatcaagttgaggaagttcccttttatgtctagttgttcagtgtttatattatgaaaatctgttggattttgtctactgctttttctgcatctatcgagatgatcatgtggttttgtcctttattctattactagggcaaattatactgattgattttgaccaactttgaatttctgggagaaattccatttggtcatggtatataatcctttatatatgtttttaggtttggtttgctagtattttgttgaggatttttctatatcttatctatatattttatctatatgacatctattatcacttttaatggctgcataaggcttaattatgtggatataccataatctaaccaattagactttaaattatttcttttcttgccattgttgttgttataatcaaggataagctcatcactgttgctcagatagctttgtattcattcatgattatttttgtaggatacattcctacaaatggaataatggaaccaaaggttatgcacagatgtttgtctcatcttgtcattgacattttcaagttgtttatagtggggtttttttttcagaggtttttaattttcaggtaagtcacatctgttttttctttatgtattctgcctttgcctataggctcagagaggcctctcctaccttattcaggataatctcctatattttctttcttttttctcttttaatttttcaagacaaaatttcactacgttgcccaggttgacgtgtggtctttcttctttttcagttttttgagacagggtctcactgtgttgcccaggctggagttcggtggctatttgcaagcacaatcatagtgcgctacagccttgatctcccgggctcaagcaatcctccctcctcagcctcccaagtagctgagactacaagctcacaccaactactgtgctcagctaaaacaatccattctttatcctagattagtcatgccatctttgtcataatctgaattcttatttctgggctttgccatgatccagtgctcatctttctattcctgaaccatgccattgtaattttttatttttctgatctattttactatctggtagtacaagtggtttgtgtttgtgtgtgtttgtgtgtgtgtgtgtgtgtaattttctcctttagagaagaatcaagttacttgatagcttctgtagagaataatcaattattctaccagatgaatttcaggacaattttataaataattttcttcatatttctaatctgattagaatttttattggaattacaacacatttataaaattgtttgcagagaatgaatatccgttgggagagcatggtatgcttttcatccagtcttcttttttgtcattcagtaaagcatgaatttggggggcgactgtaactttcttaccaggtttatttatagatgctattgtaagtaggattttttttaacgtgataacttatttaggtatattattttattatacagttgaatacatacttattttagaaaatttagaagctacaatgtgaatttaaaaagtaaatgacactcagtctgagagataagcactgttaacattttgtgtgtatctttctattaatagatttacagtctaatgagggaagtaagacatgatcacatgaaaggcttaataatctgagacactattgagtgactagcttgtactttttttctgcctagccttttttctccttttggaaactgcttttcccataactagtggagctgccaatcatccaggtccctctccacggccaatgggttggacagtgtatcacctcaggctcttttctgggagagactctctaatctggaatctcaaatgctaaagacctctagtcttgcagtgctgctgggcaaggccttcctatcctcagagcacctgtgtttgaatgataccagcttaggagagtgaagctacgaggtgattcaaaaccattcctgatgacatcattggacctcatggtctagagctggcttaaagccagcctgaattcatcctagactttcctaaatcagtaaagccaacaaactcaccattttgcttaagcaaaattgagttaggtgtctgtcatttgcagagtcccaaccactaccacctcctgtgtctgtgccatggtgccacatggggagtcacccagatgagttaggaccctgtatgccccttgccccccaggagagtgggtgttcctcagtaagagcaggttcagtgcattgtgcctgttgtctccttcaaggcaaagctggatggccatgagaggcagcagccttggccaggtggggcatggggctgccgtgccaggccaggccggctctgaactccttactgcactctgtccattagaatgacagagtctgagtatggaggttagaattatagtgaacatgggggattctatgtcacagaggctctgcaaacccatgccacctgctatataagagctctctgccatgcaagagcagactggctgccttccacacctattatccagtaaaatagcaattaaaatgcagcttgtggcaatgactaagcttagcccaggcccgctgatagagttcttggtgcctgtggatataacacatgttgcttgtttaccttcacaacatttcttcggtgtttttttctgggcagtgtatttggtccctgttgcagtagatcccattgtcactggggcttactctaggccatccgtagtagcagggaacgtggaccccaggctttgtgaggatgcccatatcattttggagctccctgaattcaaaattaagtatgaaaagatttatttagaacgaaaaaaaattgcaacaaattattggagcctaggagtttccgatgcctacctttgagatccctttagttggctcaccagaagcccctgctgtgatatgcttcctggttgtagcccgacttccccttcccacctagaactcacagtgttcacagggtcatggcaaggtggtggggcgtggctgaagcttcagggtaaatccatttgtgaagagcagactgagtttttgtttttgtttttaaatctgtttgatatctcagggagcagtcagcagctagccagcctacatcttgaaacccttacattttggagaggtacaaattaagcattgaggaccaagtaggatggaaatatgattttgcactttgtgcatgtatgcatgtaagaaagagaagagagagagagattgtgagaggcaggagagagacggggagaggccatcagaacttggggagagcagagcccgcctgcttcctgagtgaagcattgctcaagcgctctctgcccggccccctccgagtgtggttttcctcccaggccagcaccaaacccagaatagagtggctgacttgctgattgaggtcggcagctcccgagaagcaggagaagcagagtttttgcagtaagtacatcgttggttattatttaagacagagatggaaaatcttaggatagctggggaagaggtgcttctgctttaggtacaatgtcttacagacccagtggatcttggtgtgactaaggcagtgtgaatacattctcccgtggtgcatggactggataagttaatgccacatgcatgattttggggggctgaaaaaggatttgaaacccaccttttgacgtgttgaaagaaaatgatcttttctcacttgttttatcttgcaaggaaaggatgattaatgccaacttcaagttaatatatgaagttctttagaaaagaagccctgtgggtactaattagtagcagcgtggagattattttcccatccagggtgaatagggctgcttctgtgcattccttttgccaagtgtgggatgtctaaggtcctgtggagagaaccgcccactcgactagtgcttagcccctggaacgttctcgagtcatctccccttggaggagatcagcactgtagtgtgccctgtcgtctggcagagggtctgataatgtcgcaatgctcaacatctgggcaatacatacattgtgttagggtctgaaatgagatgtttgtgaagcccagatggcagagtttcaagcaataatatgataaagttggtggcttttctgggaagttatttattatatggttacttgagattgtttttcccccacatcccatcacagggctgaagataccttaaaatctctcttacccactctattttctagaaattaagtttttgctttttatttccttgtcccactgactctaatttcctataggtataaaatgtttagctcagcggtgcagaaggtccacactaagttttcttgggaaatgtggcttccaccccttctcgatagaatgctaaggtgctgctctagctgcagaactcactggtgtggctgcttctgctcctttacagctcagctccatggactctgtgtctctgtggttctgttttagagtagccgtgtttcacttcctttaacctttcctttaccaagtgagttaacatggaagcctgtctaaacagaggagcccccaaggcaggagagggggtgcaaaataagcaatactaaactttcatttgaaaacctggaatttgaaataaaccaccacctgtgaagtatcattcctcattccaattttatttttccaatatgttattttttttttagacagagccttgctgttgtcacccaggctggagtgcagtgtcttgatctcggcttactgcaacctctgcctcccaggttcaagtgattctcctgtcatagcctcccgagtagctgagactacaggcgcatgccatcacacccagctaatttttgtatttttagtaaagacaacatttcagcatgttgtccaggctggcctcaaactcctgaccttaggcgatccacctgccttggcctcccaaagtgctgggattataggcgtgagcccccacacctggccccaatacattaacatttttttaaatgatctaagtaattttgagctctcactgtacaacatcatctcatttgattctcccagcagccccatgaggtagctacctttttggtcttcacttaatagctgaggatgtggaggcctagagaggtcagagagatgggtgggcaggtaggtgagtggtgcagccaggatgggaactcaagtctgtctcaatccagagctcatgctctgatacggcatttcagtaaattcagaaattggagaaaatagtgacttaatcccacactttaaagcaactgttaaaatttctggattttttgctgggtgcagtggcttgcacctgaaatcccagctactcaggaggagaagaaggaggattgcttgagaccaggagttcgagaacagcctgggaaacatagcaaggccactgtctccaaaattttgtaaaaaaatttagccaggtctgggcgtcgtaggtcatgcctctaatcccagcattttgggaggctgaaacaggtagatcgcttgagctcaggagttcaagaccagcctgggcagcatagtgatacctcatctttacaaaaaaatcaaaacacaagctaagtgtggcgatgtgcacctgtagcaccagctactcaggaggctgatgtaagaagatcgcttgaaatcaggaggttgaggctacagtgagctgtgatcatgccactacatttcaccttgggcaacatagcaagaccctgtctcaaaaaactaaaaattaaaataagtaaataaataattagccaggtgtggtgttgcatgcctgcagtcccagctactccagaggatcactcgtacctaggaattcaaggttacaatgaactatgatctcactactgcatttcattctgagtgacagagtatgaccctgttctaaaaaaattatatatttctttctacctgtacaactagatattatagcataaggctttaaaattgttacatagtttcacaattattactatattattcttttgagacagagtctcactctgtcgcctaggctggagtgcagtagcgtgatctcagctcactgtgacttctgcctcccagcctcaaactatcctcccacctcagcctcccaggtagctgggattacaggcgtgtgccaacatgcccagctaagttttgtatttttggtagagatggagtttcactatggttcccaggctggtcttgaactcctgagctgaagtgatctgcctgccttggcctcctaaagtgctgggattacagggatgagccactgcacccagcctggtttgacaaatatttaatggcataaaatattttcttaagtgattggtccataagttatttaactattccctgttttttaaaattaggttgcttttccttttttgtgttttgctattataagtaatagattagtaaccgtctttgtccatggaactttccttatgtttttgggttgtatctgtagggtagattttcagatgtgggattactgggtaaaagggcatgaccattttaatggtgcttggtgtgtgttgctaaattactttatatcaacacagtgtgggggagcacttgtttaatttcatccattccaccagctgacagtatcatggggaaaaaagagtaagaaaaacagaaccagccgacagtatcacagggaaaaaagagtaagaaaaacagaacctctttatggtattttgcatttcttttaatacagctaggctgaacattttttacatgcttgtttacaagttgtactttctcttttgatcattttatgggatcgtaatgctggctttttggggccaatttatatgggtaagatttatttgccatatttttgtcagttattttccccagtctattgtttacctctttaaaatttttaaaaaacatgcagtcatttaacatttttatgtagtcaaattggtttcatttttttcgtaagtcttctatgttagagatctaagttctctgcttttaaggcatttatgttcttctagtattttctttcatggatgatgtgaaagtaaatttaaactggctttaaaaaatgctaaccagtttttccaatatcatttatgagcaactcttatgttttctaatattttatgattttctctttttatacctccagcttttctattatatgatttttctggattatttgattatttataggagcaatctgtttctacgccattatcgcactgtgatagcttttgtggcttttttttgtttgtttgttttgtttttttgtttttgagatggagttttgctctgtggcccaggctgaagtgcagtggtacaatctcgtctcaccacaacctctgcctcccaggttcaagcgattctcctgcctcagcctctcgagtagttgggattataggcacccgccaccacgcctggctaagttttgtatttttagtagaggtggggttttgcaatgttggccaggctggtctcggactcctgacctcaggtgatgcacctgttttggcctcccaaagtgctggggttacaagcgtgagccaccgcacctagcctgttgcttttatgatatgtagagagaatgagttgtgtggagtaatactgaggcaacataagattctggttaagcccataggcactggaggcagattgctcagccttaacttctctgtccctcagtcttattatctgtaaaatggggataaaattaataatagtttctattccatagggttgttggagtgaggaaacaaaagctaaattaaaacacacacacacactgaaaaagtatttgatgtaggtagatgtgtagagaaagtatttgaagcatatatagatgactctatatacatgagtatggattatattacatatatacataaaaagacatatgtatttttatagagtcaaacatgtcattctttccctctatggcttaagacaacctttcatgtaatcttgggagacaggaaaggttgtcttagccacagagggaaagaatgacacgtttgagttgcatatgcaaaaaacttggtacattgaaagacaagcgtgtggctgagagaaatacatgcagcacacataccacaaagagtactactcataataaatgatcccagcaatcaactagaaaaaacagacaccaaagaaaaatgggcaaaggttataaaaaagcaattcctagaaaaaggaatatagaaggccaataaacatgcaatgttcaacctcaataatagtcatagaaatgcaaattcaaatactcatgacgtgtcatttcccatgcaacacattggcaaaaatggaaaatatgaataatgttccagcatagagagaatcataggaagatgggaactggcaatcataaccaatgggaacaaaaattagtaaagcttttttgtatggcaaatttataaaatctatcaaaaggtaaaatatgcatacctttgatttgtcttagaaaaacactgtacatgtttttaagtaagcataaacaatacaaacatatttatgttaaaaattgtatgttaaaaatataagctatatatttttatttgtatgtatataaaaattcatttaataaaaagcactggatgtgtgatatcaaactgttgtttcctgtgtcacctctggagagagaagtagactaagggccaggttgctttttcctcttgctagatatacttctgtgtttgaatatttcatgagtctgaatttgtgcatttgtataaagtaaataaacaggcatttttccgggcccacaggcaagaagattcttgggagcaggatgctagctgtagaagctcaaggttgggaaagtgagtgacagattttgggaagaacaagaatttggtggcagtatttaaagatgcttaaaggtcttaacttatgttttagaaaaggaagcaacccaagaggcatggaggaaaagttgctttattgatgggcgccgacctcttccatctcctgtgcctgttttcaggctttgtgcagttgcgtccccacacacggctcgtagacgcccccgaggcactgtgctcctcactttcttttccaacatgtgttccttatctctggtttattgatttattatttatgtatgtatttttagagacagggtctcttctgtcacccaggctggagtgcagtgatgagattatagctcactgcagcctcaacctcctgtgctcaagagatcttcccacttcagcctcctgagtagctgggactacaggtgtgcaccaccgtgcctggctaatttatttatttgtaggtatagaggcttactacaggctgttcttgaacttgtgggttcaagtgatcctcccaccttggcctctcaaagtgctgggattacaagcgtgaaccactgtgcctggcctctctagtttaaaagattgtcatctgaggttcaaaataagcccttcatccattatccacccagcagacatccagcacccagtctgagctggcagtgtgctaggccctagggagacaagggtgagcaaaagagaacgtgccagcctccagggacctacgcatgggttggggaggagggacagtaaacactgatgaattatatcactgtgatggtggctgcgaagctgccattgggggctgtggtggagagtcacagagggagggatcctttccctgggtgggcaggaggcgcaaggaaactagggtcctctgaggagagcctgcatcgctgcagtctctcccattccatccctttctccgcacccctaccgccatgtcttcattcctttcactgggaccactgtttcccagattttagttctttaatgcctcttttcacagttgttgccattgtcaactaccattacttattacagttcctaaaactgacttaacattattaatgtatcttgaaaggacttaaccgcaagtgagaaacaatgaaaatgaaatgatgctaaatttaaaagttaggatgataggtaatgaaggcagaactcttgaatgtggtctagaaggcatgcatggggttgctctgatcacaaagggatgctatttatatgggagaaagggaatgtattaggattagatatttagctggcagggggactctcttgtcagtgaactcagggaggacactgtaggaaagagatgacagaaagagggagagactgcagagcatttatttattttgtttaattacaagcgtgagataagccagcaacacattacaacccgggggatcagagggtccctctgagacagactgcgggagccacatctggttgctacagtaacgggcctccttataacgagaagagccacaagtgcccgacataaatggcttggggcagaggagcaacaagcggcctaccttgctgcctcttggggaaggcagtctcggggaggtttcgcagtgggtaaagaatgagactctcgtggggagggtctcgggttgtcttgagtctaggagcttgagggcctctccgggtcttactgatgaggtcgaacatagggaaaggaagtcctcctggcttcacctgtgctgcctgcgagcccttactgcatgggaggagccccaggacaagaaggcggtacagcagcttttttgaactggcttgggatgctgagagatttgggcatcccttggccatcctgaggagggccaggcccacatgatgggatcagtgcaggggggggtggtcactggggccctcctgtggtccttcttgccggcgtcacccctgtagctgcaggaacttgaaacccctgccccaaacttgcattctccttcctgccccagtatgcctcctccttgctttgctgttccctgtgcctgtgagtttctctccctcttgtcatctagttcatgcttcttatcctggaagggtcaccaaagggtcttttccttcctgctgggtcatgtgccccttgaataagctcttctgtcactgtgtgactttttagtagcattttcccaattgatatctggtattttcaaggccatttgatagttccctacactggatggtgagccccaggtggggaggggtggtgtttggttttgtccatcctgtgtcctggtgcctactgcagtgcctagatacaggaggtgcttccagaatgattcttgagcaaacaaatgaatgagacagtccccagctgtttgtgtaaacgagtgaattcccacgactcgttttgggcctggttttttttcccagtgcagcagagcacagggaatgaaggggagaggagggcctggggagcggggatgtggggtgtgcgtgtgaaccatgggaggaagcctgcgttttattccaagggacacagggaccgactggagggctttgagcagaggagtgatgggatctgacctacattgctaaaggatcattgtggttagtgtggaaagattagccaggtggagggagagggctgaggagaggatggaggtgaattagaggggtggtggcatctggaagattgggctggactgggatctgtccggaatgtagagcccacgggtgcagcgttctgggcgtcaggatcccgtgatgtgtttgttgctctgatccgtgctgtaacttttcacaggtgagctatgctggggccctgagtttcccacattacaacacacacacaacttttcaatcaacaaacctttgctgcccccaaagccaccccaggagcccctggggcccatgtgtgccagttgaggccacggtggccccacctgcagctggctggccgttcagactcctgctgctgctcccgctgcctccttccatcacagatgatactgagttgttaccagtcaagacagggaaaaggcaccctcaaagcctcagctcttcaacctgccgttctgggcctccgccatccaccgccactcttgttttccagtgccattttgcacaacttccaccgtgctcgcgcgctgtggccaaacagcactactccttgcctgcttttgggggtgctcctcttctcacctggaatgccctctcctccagttttcacatgtcaacctcctacccatccttcagagttgtattagtctgcttggtcgctcacaacaaagtaacacagactgtaggtcttaaacaaaagacattaattttctcacagtactggaagcagacattggagtcaaaatcaaggtgttattttgggaggttgaggcaggagaattgcttcatcccaggagtttgagaccagcctgggcaacacagtgagaccccatttctcaaaaaagaaaaaaattagccaggcgtggtggtgcgcaccttgtcccagctactgaagaggctgaggtgggagggttgcttgagtgttgagtttgaggcttcagtgaggtatgatcatgccactgctctccagccttggcaacagagcaagaccctgtctcaaactatatgtgtgtatatatatatatattcaccttgtatcttcacatggttatccctctgtgtgtgcctgtgtcctaatcttttcttatatggacatcagtcatactggattagggctcaaccatatgacctcattgcaccttaattaccacttgaaagaccctctctccaaatacagttacattctgagacattaggggttagggcttcaacataggaagggagtggcggggagggacacagttcagcccatgactagagtctcagtgagatgccactttcccctccagcacccactgtgctcacacaccatagcctgttagtgggcttctttctagcactggttgctgtgtcctttggtgttcgttcgttcgttcgttcgttcgttcgttcgttcgttcgttcgttcattcatccatctaaaaatagtactaagagacatctagtccagactcctggactgtattattctttgagtcctgaccacaccaactatatctgacacaggtcacctgggacatttaattttttgttaattcatcaaacaaaatttctgaacacttctcatatgtaaggcattgatccagatgctaggcagcaggcacagcagaaggggtctgaatgccagccagctgctggtggggccactgatttgcctttccttttaaatgcaaaggcgaatcagagttggcacttccagttagttggagagacataactggcatatacagtcatacaagagaggacatagacaaaatgcttggaatttagagcaacaccaaatcacatttgtctttgtaggtgtggggagatggcagataagactacaagggtgaactgacatttgatctgggacttaaagatgggtaagatttgtgtagataggtggccttttgagtttaggcttttttcacttagcatagtgcatttgaaatacatcctttttgtgtgtgtgctattcattcacttttattgctgagttcattctttctattgctgagtactagtctaatgtggggatgcatcagtttatgtatccactcactgttgagggagagttaggttgcttgacttttgctgttacgaaatcaagctgccatgaacattagtgttacagatgtttgtgtgaatacaaattttatttctcttggataaatactgaagagtgggattaatggattgtatatgtttaatttttaagaaacttcagcactgcaaagtggctgtaccattttgcatttccgccagcaatgtattagagttccagttgctccatatccttgccagcacttgatactgttttgttttgtttttaaatttttagccattctagtaggtgtgtagtgatagctcttatggtttcaatttgcattttcttaatgactaatgatgtcaagcattttttcatgtgcttatttgccatccaaatatcttgtgtggtgaagtttttatttaaatatttggtcattttttattgccttgtgcagtttattattattatttgttattaatatggacatcatttgttatttttaacaaaaataacaaagaggctgggcactgtgactcacgcctgtaatcccagcactttgggaggcgaggcgggcagatcacctgaggtcaggagtttgagaccaacctgaccaacatggtgaaaccctgtctctactaaaaatataaaaattagtcgggcacagtggagggcacttgtaattccagctactcgggaggctgaggcaggagaattgcttgaacctgggaggcagaggttgcagtgagccgagactgtgccgttgccattgcactccagcctgggcgacaaggggaagactccgtctcaataaataaaaaataaaagtaacaaataataacaaaaatggttattattcaagaattcaagattcaagtcctttatcagttttgtgttttgcagatatttcccttccagttgatggcttgtcttttcattttgttgacaatgtcttttgaagaccataagttttaaattttgacagtatcccattaatcaggtgggtttttttgtttttttatcttagttattttattgctcatatttttggtgttgtaactaagaaatctttgccttactcgaggtcacaacagttttctcctgttttcttctagaggttttctagtttcaggtttcacctttaggtcaatgggctgtctttaatgtggaccagacactgggcccacaggtgtggaaccacagaggaatgagacagagcccttcactcagggaccatctgggcaagggaggtgggggtgggagtcacacagggaaacagtctttgtctggtgtaaggcctgctgataagcctgggtccagggtgctgtggacacactgtggtgtggaagcaggtctgtgcccagacaaggggctgtgaactgaggtttaccagacagtagagggtaagtgaaaagcaggagttcaggctgggaagcctgttctgggcttagagtggccttgggcaggcctggaggctggatgatagaactcagcatccctgcagctgctggtcatttgctgtgcctggggtcaaagtgcaagacagctggcaggagtgggcagaagggagcaggggcctgagcacttggtgtgccttatcctccaacaaagaggaggtggaggtggcttcatggcatggctcaggctgtgctctttgagggtcgggggtaactgtccctctttattttgaaagtcagatgtgtctgtgtcataaagggcacatccatagggggcagcggaagtgctgttacataaccgtttctgtccctcacgctggaaacagatcgcacagcagttgctgtacttgctgttccttgtagacttactcctgtgcaaggaacgtgtaatgacaaggtaatcccaggagcagcctgcaaaattatccgtcgtatttgtggttcctgtgtatatttaaaacacaatgctagaagcgattgatgctgacgaaggatagggcatattccaggcactgaataaattaaccctgcaaagcacagcagttgctttcattagccagctggcactgcaggaatattgctaaagcctgtgggttagaaaagaaaatctcaggaatgcgagaacaaaaaagaaatcagccacattcagtgatttaacttaatctggcaacaataaggaaatccagaactcacggtgctctgagcaatggcggactcccgctgcatgtgcgagtggatggatattccctgttcagtggaggggatatccaccacgactctgggtacccacggcgggatgcagatgtgagttagggccatgcggcgatgatccaggttttgttcctgcatcctctgcaactagagaagctccagcaaagttctgtgttcccctcttttcttcctgatgtccccaaggagtgaagcaaatgaataggcctagctaatgtgccatctctctctcccttctctacctggccaggcactttctgggatggctgctgccatcatgtccatgacactgaaggcctctgctgcctgcagtcccactgctgcctccgccaccctgggcaccactgctgccttgttgccctgtggctgtgaggtgccatagtgccaagtcttcagcacgccccagaagccatgatgagtatggtggaggcctcagaattttcctggggaagtagctctttccatgttgccttgatggccctgttcccacctcctgtctctccccctaggccaagtgttatcccaggagacccttcacttccacagacagacagacagactgccagggaccctcctcagccagcctcttcacatgccgaggccacagcactcagtgtggttgggtccagttgagaccctgctgctcatgacttaaggcttctgtgcattgaattaagccactaggggacttatgagatcaccctctggcttctcttgttgggtcccatacagccagtatgtgtcaccaggggcatgtggcatgtgtagcctgcctctcctgagtttgcagagctgggctggctcctccttgattttatcttcctctggaccagagtggctgaagtatagtgagcagagggaggggcagtggacgtggtgaggggccagacctctccatccatgggtgggggctctcgttatggagggtcccttttttgcgtctgtgctcagcagtgcgggggaagagggtttgtccccttcctcccaggtcctcatcgttcaaatgcacggaagcatgttggtagagcacacagaggttttgctgggtgggtggggcagcatgccctgcagttcttgcattgtttccagaggaaatagaatagaatgcaacagaactggcctgcctgttgcctgggaagctgttctcctgacatcacagggctgtgcccatatccccgcttggcttaggggcccctaagttaggaacaaagaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtgacttctgctgatgggatcaatgaattttactttggaatttttcttctgatgctgtatggaaatctgttcttttccttatttactgggaaagaatctgaggctattgggatgatttttcatctcaagactgtgggaaataatcagctttgaagcatttcctgtggccatttgctgaagtctgggattccgtcagctgcgccccaaccagattttcagtgttaatgtttccatgttaggtggtgaggctaagcagatatgtcatgtgccggctggtctaggagccagtgtcccagggctctcattcttcctctggaagtctctccaccgtggcactgctgacattgtaggccagatgcttccttgttgtagggctcccctttgggttaccgatgtctagcagcatctctgggctctgtccagtagcaccccaagttgtgacaccgtaaatgcctctgcacattgccacgtgcccattgggcttagaactactactgtagaagaggtcaggagcaaattcgacccatgttccaaaaagctccagctcagtattttcaacatgtggttcacttacgttctatttcctgctgagtcccctggcaattgagctatgtgcacattcttattttgttggttctcagacttgaatggtttggcctcttccgcttcccagtgcttattgtgcttgtagccgagccctgagtgccctctcccactcctggagactcgtcattattttctgattgtccagaatggtttcccagttgcctttctatttcttgccttaaaaggataatgaagctgaggcccgagataacctctccaacgcaggctccgaaggcagcaatttagtggcggaacagcgtgttttcagggagcaggagacgtgtggactctgactttaactgttgcccagcgcctaattgtattccttaaataggggttccctctctcctccttttctccctccctcctttctcttctactttacactgtgaaatttaagagttgcagtttaagtcctacactattctggagaggagagaaacttggtaagaaaataaaatgtttgacaaatttaaagaaaacacccctggaacgacatcccccaccccaccatgggtgtggggtcctagatttaactgtaattccttgatcgatgtgatcctttgtggtgttcatgaggattttaggaaatcatgagattaataatagaaaccttcttttcactgtcttgtacttggctggagcctgtttattttgtatggctaattcatatccataagaaaacgattactcagctagcattcccacctgtgtttatctttcagcagccaggatttgttaagccctgggcaattttaattgctgtgaagtgtcttccctgcaggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatcaacagtttttgtcgagagggcggctcatagttgtcaacagccttctgtgtgcctggcacctgatggacttgttctcctttcatctttacagttttatgaagttggcactgataactccatcttattgggtgaagatgtagagaatcatgttcagaaagcatggctgagttcacaatgtcaacagtggagctgaatttggaccaggtgcatttgatctatagccttggtgctctccagggagcaaagattattcagagaggccatccgtccctggtgtttaggtgtgtaggttttggaaccaatttaaactggatctgaatcttggctccaagataaactctgagatttgggcaagttgcttaacctcccttggggaaatgaagtttccccacctgtgaaatggatatgtcttagtctgttcaggctgctgtaagagaaataccataaactgggtgacttataagcaacagaaatttattgctcacagttctggaggctgcatagtctaagatcaaggtgccactagatttggtatctggcaagggcctgctgtctggttcatagatggagtcctcttgcagtgccctcacttggtggaaggggcaaacaagctccctcaggcactaattacattgatgagggctctgcctcccagatgccctacctcctaataccacaatgggggttaggttccaacatgtacattctgggagaacattcagatcatagcaggaggtgacccttacctcgtagggttactgagctatttacatagagcatttagcagtgctttgccaggctcagaatgaaataggatagctgctctcagctcatgacagcatttatgtaaatgaactggcttcagagagccaggctgaggggctgagatgacgggagggatgtagaagtggtgggaagtggattgggaggaaacctgaagaaacttggagtgggcctaggggtgcacctgctccccttctagtaggagtccttcctgcaagtggacggagggcaccatattgtgggttttttgtttttgtttttgtttttgttttttgttttttttttttttggagatggagtctccctctgtcacccaggctggagtgcagtagctcaatcttggttcactacaacctctgcctcccgggttcaagtgattttcatgcctcatctccccaagtagctggggctacaggtgtgtgtcaccacgtccccctaattttttgtatttttagtgagacagggtctcaccatgttgcccaggctggtctcgaactcctgagcacaggcagtccatccaccttggcctcctaaagtgctgggattacaggtgtgagccactcccagcctatattgtatattttaaatttgagaagaagatgggatttgaggagcagtgtatggctgatgggtgggtacaaaatggaaggccttgcccaggaaaacaatgatgggaatgaagccgaagatgctcaggaaagggagtgtgggcagcaggagggggatggatgaggagcattttctgggtgcagtcatgtgggagtagttgggttgaattcagagggtccaagagaaagggaccctgatgcaacaaacatgggcctggacagtgctgcctcagagcgggccacctgccaaccctggaaaggaggctgcgtgttcgtcaggggcaccatccacaggatcgacgcatttgttgccagagattaagagagaagtttagatcttttaattttgactgaggtggcttttccttcttttctttaaccaaggacttagactcctgaaatgttggggaaaaggttgacagggaaaacatccaccctcttcctgctgtttttcatctctatatttttctcttttgtggtggtgtggtggtgggcaataaataaaaggcatttcatttcaggggtaacctgggcagattttggaaaatgtagacagattgcaaaatcatcctatgttttcataaagtaagccctgtaatatccagtcctttattttttttttttatttagagagaggttttcactctgtcactgtcccaagtagctgggactacaggtgtgcaccaccatgcctggctaatttttgtattttttgtagagacagagtcttgctatgttgcccaggctggtctcaaactcctagactcaagtgatcctcccactttggcctcccaaaatattggaattacaggcatgagccactgtgcctggactgtaatagtcatttctaagtaattctaatcataacataaaagggtgtcttgattaaacagatactttattaagtcatctccatgagtcagtcagactgacaggttgctggttgattctgcagtaattggtgaaattcatcagtaattctcttcaagagtcactccggctctgttcattcattttatattgggaggaggtcctcatgaaattagttactgtataggtctcaacctatgcattctttcattgttgctgtggaaacaagcaataaaaatcgtgggttgaagaagaaaaataatcggtgctgaacatctgtaaaatacatgataattaacttgctttctgtaatccagaattttaaaaaaatcatcatacttggaacaaagctgagactcataaggttctgaactaattatgtaactgaatcattaatagttttccttggaaacactgtggaaaacaaattacgccgcctttaaaggagtgtttccactggtagcagcattcacagagccgctgccatcagctctgcagcgtgagctcagtcagatgcatgcctggacacacgccaccagctggtcactgtttcaatagggtcgggaactagatggtcgggaactagagagacattgtcaggagaaacaaggtcgcagactgagcaggatgctgcctgtggttcttctcgtggctggctaacgggctgtgaggggagaggcagccagggacgctagcactggccgccatcccccgggggcagttagtgagacccaccctgcccccaccctgtgcactgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggtttgaacaattttcctttcataaaatattgtagttagggcagtcactctgcccaacagtgttgggtctgaccaattaaaatatgcttcattaattttttatgatacccatttttatccaaaagaagaaaaaagtcattttgtgcttctgtgaattctttcaagtaattcatttatgtttattttaaaaataagtatattgttcctttgtcaaccctaaagccacaaagcttatgggcattttattggttgactctggctgacctgttttatctgggtgtgagatacagatacatagtgtatgggtatttggtggaatgctgtctcaggtcattctgctgaaaagtgatgtcaggacatcagtaatgtggatatgtttcagtagtttggtaaaagctgttatggagttgtaaaaattagcctagtataaagcctataaacccatcttaggaatattctatttccagccaaatcataggtgctcctactctgtgatagttcatggtgacgtggtatgtggggtgtaaagtgtgatgatgtcatgcagcaggttcaagtgatggagacatgtttttcttttctgctcttttgcaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcagggtatggatcaaaatgcacagggccaggcagagcgcctggataccctgggttgggaggattgaagagggcagtaagcaaaccagtggcctctcggggcagggaaggaggctcccaaggaggggtcgcaggaggaccagcatgcctggacatgaaggaatagagctagcgggtgggagtgggggccctctggggtccagaaaggaggtctgcaaagtgtttaacacagtaattaaggtcctctgccctgggttgcatggacatcccggcagttttgccccaagcacggccctggataggggtcgaggtcatgcacgatctttgcagccccccacaatccagttgtagttcttcaagcccctcttactggaccccgcagcagcatggacgctgttgattacgcccttcatgagggagtgcgttctcctctggttttctcctccccccatccctttggtctctaaggttgggtgggcccatgccacattcctagactcatctcttttctagctgcattcatttctttacatgagaggctctcaccgtgcaaagcctagtgcctccttagctgccctgagatgaattcatagacagtagcacctacctcatgcaatactttagaaaagtcaatatgatcttctatattagcatggatttccatctgcacagctgtgctaaaggccttgagatgctccttaaagcaccacgggcgtgacagctacaatgcagatggatttgagatgcagactgatttgaattgtgttgatgactcaactacggtgaaggctgctgcagaaggagtgacgggattgttttgaaatagcagacactcttggtgaagttctgaaccaagcatggtgccggctccctttgttttagtatttttggacttagagcagacactcttggtgaagacactcttagagctaggcaaggggcacattgtttttatgagtcaaatggagggaggctctaggctcagataataataaaaggtgttccacctgtgtcagtgcctgcggaatatgtggaaagtgtgtgggtcgtggagcagttctttgtgtaagattgtcatgagcattttaggacatctgaatttcctgtcctcctacccgttaaatattagtaacacatccagtcatggtgacaaccaaaaatgtgccctcagattttcaacacatcccctgagggacagccctgtccccattgagaaccattgttctaggtgacgggtccattctcatggcttttaacactctaagtggataacgtccaaatttgcatctccagctgggacccctctaactgcctttgtgacatcacccttggatgtccaaaagtgtaacatgtccaaaaccgaatctcaatgccttcctctccatctctctcaccatcccctaacctgctcccccaaatcttcccatttgtgtaaatagcaactccatcttcttggttgctcaggccacagccagtggcatcacccttaaaccctccttttctcatgtctcacagtccatcagtgaaatgccatcacttctaccttaaaaatatgtgtcaactccaaccaattcccactgcctcccttgtgaccagttgggtcatgcccccacccttctgtgccctagtcctggtccttggaacacctgagtcatgtcacttctctgcgtcaaccctctagtggctctccccattcactcagagtgaaaagcagagtccttgaaatggccagcgatgccctcagggcccaaccctgtcccctgcctctcaggtgtggtctcgctcctctgtgccctggctcctggagctccagccacacgttctgctggtgtttggtgacagctgtccttcggattgccaggtgcactcctgcggcagtgtgtttgtgtttgctgctccctctgcccggaaagcacctggtgcctctataggaagtgtccttgacctccatcctcctcctcctgctgccttgttttccttctctgctcttgatgccattgcacacacctgcttgtttacggtctgtcttctcatggctggaaagtaagccccctgcagacagggactgtatgcttcttttttgtactcggctctgtccctagtgcttagaagagcacctgctacctggtaggcactcagtatttattgaatgatgagcacacctgttttctggcggtctgatggaacaagaggagcttgggggcgtggggctggcctgagttggaatcctggctctgccacttccccactgtgaagctgcaggcaagctgtgtagctgccctgagcttgtgcttccttgtctttcagatgaaggtaacaccttctttgtcataaggagtaaatgtgggtaaagcatcctatgtgtaattttgtttattattctattatcctggattgaaacatcatttccattatttttgtttttattattttcaacccaacagcacactttaaacttagatttttatgtttattattattttttctatatccaataagcaacatataaacttagatttttaaatgaatacatacattccacaataacagatcattagagctgctggaatacggaaatatttttaaaagcagtgtttaaaataaggcctcggccgggcagggtggcttatgccactttgggaggctgaggtggatggatcacctgaggtcaggagttcaagaccagcctgaccaacatggtgaaatcctgtctttacccaaaaaaaaaaaaaaaaaaaaaaaaaaaattagccttagccgggcgtggtggcatagtcctgtagtcccagctacttgggaggctgagacaggagaattgcttgaacctgggaggcggaggttgcagtcagccaagagcgcaccactgcactccagcctgggtgacagagtgacactctatctcaaaaaaaaaaaaaaaaaaaaaaaaaacccacaaaatatataaaataaggccggaagaagcataggaatgtttctaaaggacaatgaatgagatgctggacacttctcccattgataggttcatgttttggaaacttgttccaaagagaaaatgtcagggaaaagcaaatacagtcattccttggtatccttgggggattggttccaggacccactgtggataccaaaatccatggatgcttaagtccctgatataaagggtgtttgcatataacctacacacatcctcccatatactttaagtgatctctagattacttatgatacctcatgcaatgtaactgccgcatacatagttgttatactgtgtcattttaaatttttttattgttgtattgttaatttttaaaattaatgttttgaataactttttctgcacttggtaccatgcgcatattaggggccttctgctctccttcccgattcctgtcctctccaggcctgattctgtgcaggaaaatgatagggcttgagggaaggagcagcagaaagaaatgtagcccgcctgacctttccagccctggttctgttcctctgatttgaccttaatctttccacctatggtatgggaagaagaaaaatactaaaaaggaagtcagagagcagaagagagaaagaggaaatggtggtggacaaaaaagcaagtaattttccctcccaatattttactgtgacaatttgtaagcacacggggaggttctacagtagtacaggggatcccacagcagacaccatagaccaccacctaggtcctacagttagcatctcactatatttgctttataggaaatggatagatagggtttcactggtcaaaacaggaacactgagacaaatccactgaaagtagaactgaatacctgactttctttttttaaattttaattcgaattattatttttttaaaattttactttaagttctgggatacatgtgcagaacatgcaggtttgttacataggtataaatgtgccatggtgctttgctgtgcctatcaaccagtcatctagattttaagccccgcatgcattaggtatttgtcctaatgttctccctccccttgccccctacccaccaacagacccgggtgtgtgatgttcccctccctgtgtccatttgttctcattgttcaactcccacttatgagtgagaacatgcagtgtctggttttctgttcctgtgttagtttgctgagaatgatggcttccagcttcatccatgtccctgcaaaggacatgaactcattcttttttatggctgcatagtattccatggtgtatatgtgacgcattttctttatccagtctatcattgatggatgtttaggttggttccaagtttttgctattgaaaatagtgctgcaataaacatacatgtgcatgtgtctttttagtggaatgatttatattccgttgggtatatacccaataatgagattgctgggtcaaatggtatttctggttctagatccttgaggaatcaccacactgtcttccacaatggttgaactaatttacactcccaccaacagtgtaaaagcattcctatttctccacagcctcaccagcatctgttgtttcctgactttttaatgatcgccattctaactggcgtgagatggtatctcattatggttttgatttgcatttctctagtgaccagtgatgatgagctttttttcatgtttgttggctgcataaatgtcttcttttgagaagtgtctaaatacctgactttcaacattggcctgaactgaaggagcagtgaaagaaagcagggtgcagaggctggggacgtggacactcagggagggtgcatacactcctgtaaatcctccttgtggtatctgagcacagcccagaaagaagagaacctgcagtgtcatttgcgaggcccaggtctattaattggggtcctcttggttgcaaatgatgaaacattggcttaagcttgcttcagcagaaaaggaatgtactgagcagatcctaaggctcccatgtcactatgagcgggacaaaggtgcattttaacaaacccttcctgtgactctgatgtctgctcaagtttgagaagcggtgtccaaccataacatgttatccaccagtaacgaccagattatgttatgtctgatgattttagggctgtgaattcttttctacatctttgtggaattgagaggaatttcttagttactttaatctgtgaggcatttgaactttttccttttatatactttcttatacaggtggttggcagcttaaatatcagtgaagctgttaatgaagatacttactaaatagcaaagcagcaccgaagtgcacaccttcataggatcttctggagcaagccagaaatctcaagtggtgctgtggccaggaaacaaagcaaaaaatgcagtggtgaatagagaaggagcaagaattagtaactgagactggtagctttccttttgatgttgcatccaaaaagcagtgacaaagtaagagtagctaccttcagctgtttgttttgaaggacacgtgggatcagttttttgtctttatgtcctacccccaggaaaccttttaagctaccagtctttttcaaatggaattcctcgtggaaggtgcaggggaaatgaagtgctccccttgaaagctttgctgctacccaaactccatgccctatgggagggaggtggcacagcactggcctgcagcacatcatacttatcctgttgtctgggaaggacaggaccacatctacccacagtgcagcataaaatcccctagtccaagaggagacagagtcagctgagtgtggctggctcacaaaatggaacacaatagctgatgtgtgttatctctagctgtgcctggtgcatcacaggcaggcacactatgcatttttactgaatattgttcttggatggatttaccgaagaagagcctgaggttcagagaggttgatgacttgcttgatgttctattgtactctctggaatccccgttgcattgcgttcatttttcctaaaaacactcccctcctccctcctcctccttgccttaatttgaatttagtttttacaggataacaatagtaaaaacaataatgatgattttcatttgttatcgttatagttggtgtctgttcaatgcatactgtgtcagacactgttatcctaagcacactgcatggctaacttgtttaatcctcagagcaacactctgaagtgggtaccatgatcatacttactttttaggtgaagaaaccaaagcacagagaggacgtgatttgcccaaggtcacacagctaagcactggcagagccaggattcagacccaggtggtctgtattttcagcccttggccactaaactgtgctgccacgtgacatagcttttttcccaacccctgtgacgtgggatggggacctcctggctcctgttggtcttcagcctggtgttgctgtggaagacacccacccctccagaatgcctccctgccctctctgcctgagaaaaactgaatcatggcctcttctgtgaggtcttgggactcccccagcccctcctgggctttctccacattcgtttctctgcagcttagtgctgtcctcagtgtgttctgtgtggttatatgggaacctcctctttaggtggttaactctgatcggcagggcctcctgattcactttgacattcatgccatatgcacagcatacagatcttctaagtggacgtaggctaaagatgtacgtccagcctctagtgggtttttggtaaagcttagctgaattacagtgttcagaatgggagggacaggaatggagaagccacaagcccgacagaagcagccctggcaaagtgacaagaagggagggaggggtttggagctgtttctcctgccgatcttcccttccctctcccacatacatgtggagggctgctgcagtctccctaggagcatggcatcccaggaggagtgcccccctctctccccaggacgtccgcatcccccgtccacttcctcctggcactgaaatctggactttatctcactgcaggattcactgaaaggctgttggatggctggaatccccttcagcctttacagctaacatactaggtgttcccatattctaagggctcttttactgtgggtgagctggctggaggagaaggggagaggagaagggggacgagaaagggagccccaccctctgctcaggacccattgttcacattcttttccgtgtgaaatgttgctgcatccaggccctaggctatgagtggtggcatttctatgtttgtggaatgaatataaagtctgttttaggatcagtggacaaaaatcagcatgtttgaagtggaggttacaatcagttggttagtacgatatttgacatttaccctgggcccttaatggtgcagtttttctgatgtaaggagggtgaaaaagcagccactatgtgtactaaacagaaggcgtgatgagtacagtcagtgcaggatcgtgaaggcatcagcacattccttcttcagctaatcagcccagacagtgtggggtatttttgtattctctgctgtttgtgctctgagtacatgtgcacaaaatgcagtgacactgatcaataaactctttaagcctaataagcatatgcagtctcatagcaatgaggacataaacagggagaaggatcttaggtgattcaaattctcttttgttggccaggcacggtggctcatgcctgtaatcccgccactttgggaggccgaggcaggtggatcacctgaggtcaggagtttgagaccagcctggccaacatggtgaaatcccgtctctactaaaaatacaaaaattagctgggtgtgggggcacgtgcctgtaatcccagcttcttgggaggctgagacaggagaatcgttcaaatctgggaggcggaggttgcagtgagccgagattgtgccactgcactccagcttgggtgaaagagtgagactgtctcaaaaaaaaaaaaaaaaaaaaaaaaaagaaaaaaaaattctcttttggaggtgaggagactgagctaccagatccaaacctttccagggctccatggctcacaggttgcccgattcctaatacagcatggtacttcatgccctccttccaaaggaggatttagattttgtttgtaaatctaaagatgcttctgttgctgccagcctggagaaccaccatggagagccactaggaaaacagctgcaatgatgatgttgaagatgatgagagcctccaacatttatgttcttaataaaatgctttaaatttttaactaagggcacaactctagagatacgccaactgctttctcttttttttttcggtgggggggcgggagacagggttttgctctgttgcccatactggagtgcagtggtgcaatcatggctccctgcagcctcgaactccagcgatcctcccgcctcagcctcctgagtagctaggactacaggcacgcagtgccacaccccactaatttttaaaaaagattatttgtagaaatggagtcttactatgttgctcaggctggtcttggactcctgacctcaagtgattgtcttgccttggccttcaaatgttttctccattttagaattgaggaactgcagcatcagtacctgggtcatataggtaggaagaaggagcgctgctcccttcaccactccctgggctgcctccttcctgtgtgattgcagggaacctcctatatagagatcccagatcccaagtcttcttttgcatgtcccactccctccccacccttgaaaacaaaaacaaaccctgcgatgcagcacttactgctgactcctcaccagagaccccccagccctgagcatggtgctgcagctacctgtgctttccccccggtcactgctactgcttcacccctgttcttatcatgactggcgccacctatgttaccatgccaggtcctcttgcagtgcctcaaaggcaaaactcccactgcttgcgcactgctgtcttgtgttgcctccagctgtcatctcaccaagaccttgagtcccaggaaccaaccccttatggaagggggcagggcaagctctacctctgctgctctggggtggtggctggggatggaggctgtggtgggatctccgagggggtttcacttctgttcccagtaggagtgctctcatttgttggatttcctggtttattctgggtttcagagagcccttcctctcttggcctttgctgtagagtttgaaaattctgtactttgagtcagacttgcagattttagaaatgtcagagaatcagataggggaaaagcagaatccaccgtgtatggcttgcgttattgcgttaagaattcccttaaccactgtgatttccctttttcatttgagaagtcatctagggagttttcaaagtttcaaaccagaattgattttcatttggggaccagggaggcacctgagtgtgcttcttggaagagtgagtaatagtttttctctattgagaaaaagctgccaacattatagactatggtcatttaatattaaacatgtattatacaggtgacctgatggatggtttgagaggttggagagcttgagtgaagggatgctttttactctgagatgggaagtggaaagaccattacagagttctctaagaagggtagtagtgtaacttctggattaactcaagtgtcatgtttggtccatgatatggtttggctgtgtccccaaccaaaattcatgttgaattttagctcccataatccccacatgtcacaggagggatctggtgggaggtaattgaatcctgctgttctcatgatagtgaataagtctcaggaggtctgatggttttataaaggggagttcccctgcacatgctctctcttgcctaccaagagtatagtgagatgtgactttgctcctcctttgctttccaccatgattgtgaggcctccctagccatgtggaactgtgagtcaactaaacctctttcctttgtaaattacccagtcttgggtatgtctttattagcagcatgagaacagactaatacagtccagttgctaaattaggggactgtgctgttgttcagaaaatgtggtcgtgggccaggcgtggtggcccacgcctgtaatcctagcactttgggaggctgaggcaggtggatcacccgagatcaggagtttgagaccagcctgggcaacatgatgaaaccccgtctctactaaaaatacaaaaatcagccaggtgtggaggcacacgcctgtagccccaactactacttgggaggatgagaatcaggaaggcagaggttgcagtgagccgagatcgcatcacggcactccagcctgggcgacagagtgagactcgtgtctcaaaaaaaaaaaaaaaaaaaaaaaaagaaaagaaaaacaaaagaaaatgtgattatgctgacatctagtaactggagttgcacacaaatcatccttttaatgtgaattacttgtttttaaagttaataatttgttttgaaatcttgaccaagattgcatggctaatatgaagacatccaccatcaggctgggagtggtggctcataccgataataccagcatttgggaggctgaggtggaggattgcttgaggccaggagttcaagaccagcctgggcaacatagtgagatcctgtctcttcttttcttttcttttttcttttttttttttttttgagatggatagactgtttgccagtatagagtgcagtggcgcgatctcggctcactgtaacctccatctcctgggttcaagcgattctcctgcctcagcctcccgagtagctgggattacaggcatgtgtcaccacacctggctaatttttgtattcttagcagagatggggtttcaccatgttgaccaggctcatctcgaactcacctggctaatttttgtatttttagtagagatggggtttcaccatgttgacaaggcttgtctcaaactcctgacctcaggtgatctgcccgttttggcctcccaaagtgctaggattataggcatgagccactgcgctcgaccatgtgatcccacctctacaaaaatatttttaaaaaattagccaggcatagtgttgtgcacctatagtcctagctacttgggaggctgaggcaggaaagcccaggaattcaaggctgcaatgagccatgtttgaactactacactcctgcctgtgtaacagagcaagaccttgtctctaaaaaaacaaaaagacttctaccgtcatccctcttgttaaaaggcaatggcgagttactgtttaatgagtagactttatttgtgatggtaaaaatttctggagatggatggtggtgatggttgtacaacatggtgaatgtatttaataccactgaattgtgcacttaaaatggtgaattttatattatgcttattttagcacagtaaagttttaaaaattacaaaaaaaaggaaaaaaaaaaaacccagaaggctagtatttgcaggagtggaactaggactttgcctaaattgcaaacttccttcactccaattttctttttctgttttaatgaagcacagcatatttacaataaaatccataaagtacactaatcttaatcttagctataaagctcattgcatgtttatatttttttacacttgtgtaaccaccaccctgtcaatatgttgaacgttccagcaccccagaaggtttctttttggttgtaactccccgagaggtaaccactattctgacttatattaccatcatttgattgtgcagcttttaaacttaatacaagtggaatcaggcagtatatactcttttgtgtctgcttctttcacttagcataatacctgggacagccacccatttattagtatatcagtaattcatttttttcctatttgctgtgtggttctcattgcatttatcctctctgttgaaggacatttgggttgttctagttttgggctgctataaaaaaggtgctatgaacattcttttgagggacctatgtacttgcttctcttgggtgcggatctaggaatgggattgctgagtcacagggaactgtgcgtgctcacttaggagtctcccttcttcgacttactgcctttcagcaaatgtttgtcctacccctttcatgacagggaagaaagcaaagcaagagcagagggtgttgctttcttctattttccagccttagcgttagtagatactgccactttccaaagcagttatgccagtttacacttccactcacagggcatgagtgttccagttgcttcacagcctcaccaacacttggtattggtgtttattcactttcaaactatggtggggtgagggtggttacaccctgaaatttaaatgatgcaaagatggaaactttaaaaaattgtgcaaatatttaaacttctaactctcagtaaatgaccccaaagccagtggagtaggatggagcagggcttttcccttcagcctgtgtgatgggcggggctcgcccactgcatatcgacattgatttaagggcttttccttactgtgtgctctggatgtcagatacattagacagctttgggcagctgccttctccagtcttccggcactgttcctctccagagccttctttcatgaagacccaacagtagttgagagaattcagttgtggtttttctcattaacgttgaatgtaatctatctgggcctgaagtgtggatcacttaggagtctcctttcttagacttcagcaccttttagcaaatgtttgtcccatgacagggaagaaagcaaagccagaacagagggcgctgctttcttctgtcttccagcctccaagatttcctttctcacctttgaacacattttctgtgtcagatcatctacagaatgcttggtggtgaggccacagcagatactcagattgtttctctccctccacctcctcctggcctatgtcatgagcctttttttgttgtcctggaatttcttttgcattgccctaccctgccttttgtgcatctcccagttcttttttcattggttcccattctttttttcccccaccaggagagcagatttattttttatttaaaatttttgtttagagacgaggtttcactttgtcacccaggctggagtacaatggcacaatcatagcttactgcaaccttgaacttctgggctcaagcaatcctctcacctcagcctcctgggtgtcaccatgcccagctaattaaaaaaaaatattagcgagacagagtctcactgttgcccaggctggtcttgaactcctgagcccagcagtcctcccacctcagcctcccaaagttctgggactacagtcgtgagtcactgtgcccagccacattttttaaggctcattacttgaagtgtgacctgatggtattcttcacgcacagtcttagacactgctctttgaaacagtcatgggagatcatactcggacctgttatgacagaaacaggtttgtgtagctttgcattttttcacttcactctatcatgctactcaaagtgctgttattgtatcttgactgctgggcacatagcccagctcccatgctctgcttgtttatagcgctccttcctgaaaaccacctcttcatcctctctctttccttccaactctctcagctcaagagggccagcagtgaggacacgctcaacaagccaggaagtaccgctgcatcgggggtggttcgcctgaagaagaccgccactgccggagccatctcggagctcacggagagccgcctgaggagcggcacaggtaggagggaccgggcaggtgggctcggcaggccatcagtcctggccgcatggaagcacttcagtgacccatgacccatccattccttccctcgtgaaatatttcttgaccacttaccctgggccggaactgttttaggcagacgatgtcgctgcccacagggagtttacatctatagagtggggagaccgatgagaagcaaaaggtaactgggcgtgctgtggtttctttggtcccttcggaggtccatttgtcaccatgcacgtgtgaaatccttctgacatccaagcagggcggcatatgttctggggctgtcttgatacagaatgcattagaggaatgaatgaaccctgttgatcccttgcgaaggtgggtgtctaatatttgtactgaaccctatggaaagctgggaagagcctcgcccagcagctgtggaaggctgctcagagtggcttggacggcagtggcaacaggaagctgtgaaccttctcagtgttactcattttttaagaatcagaaaagggtttttcaatcattatatttgagttcagagcatgtgaaacatgaaatatcaaagaatttatttaattctctctttgtgcatatagataataactcttaagctttcatggcctaactcttacagtgcagccctcagtgtattgctaaattgtctaagacgggaaaaataactgaaatacatcgttactaatttttaatgtgttgaaggggcacttataatttttgtgctcttttcgtaaaagtcacattcaggctagatctcaaaaggtatattttaatttatcagtttttaaaaagttgaatctgtgaaaaccatacaaggtattcttttcttggatataaagggaatggcctggtttttctatataatggctttaccattgtaaatactgatattgtattaaacatacacacacacttggtttttaaaatacaataaacaaaagtaccatttatttttatcaagccagcctaacagtgatcccaaaagttaataaagccccactcaaaaaaagacagactgggaggagcctaggggcagggtgggaatgaggaccagccgagtcccgggtgtgggacaaattgcgtgtgtgtggtgtgtccccaaaagcaggaaggtggcgaaaggaggcgaatcccagtgggtggagggaggggaaaggcggaaggagaaaaaggtgggaggaggatcgggtgggagggtggtggctcactcaggacccagggggggggcagcgcgatgaggtgggtggccctgttcctgaacggcagccccaagaagggaaaggtggttgctgtatgtggaactttatctgatttgctttctgtggccagtggtaaacttggcataaaagccaccagtgtgtataatggcaaaggtggactgattgatgatattgctttgatcagggatgatgatgttttgtttgtgtgtgaaggagagccatttattgatcctgacagattctaaaccacctgagggattgtcaggattccacatagactggctaacattaaatgctggaggggcggtactttacaaccacacagagcactttagtgaataaagaacctgatagtatgctggcccacatgtttaaggacaaagatgtctgggaaataagcaagatcacagaggagctttcttaattgaccgaagtcctgagtactttgaacccattttgaactacttgtgtcatggagagcttattgtacatgatggcattaatttattggatatgttagaagaagcaagattttttgtattgactcattgattgaacacctagaaatggcaataaagaattctaaaccaccggaggatcattcaccaatatcctgaaaggaatttgtctgatttttgctggcaacttcaatcaagtcagaactgcgatgccaaggtttgaacttcagtggtgctgatctttctcatttggacctttgaaacattaacttcaaaatggccagtttaagccgctgcagtcttgcacatgcaaatctttgctgtgcaaatcttaaacaagctgatctctctggatcagtgcttgactgtgcaaatcttcagggagtcaagacactctgttctaatgtagaaggagcatccctgaaactgtgtaattttgaggatccttccggtcttaaagccaatttagaaggtgctaacctgaaaggtgtggatatggaaggaagtcagataacaggaattaacctgagagtgactaccttaaaaaatgcaaagttgaagaactgtaacctcagaggagcaactctggcaggaactgatttagagaattgtgatctgtctgggtgtgatcttcaagaagccaacctgagagggtccaacatgaagggagctagatttgaagagatgctaacaccactacacatgtcacaaagtgttagatgagaattttaggggctggaggaacatgtacaagatgaaaatgttttccttatcacttttctttctccacccgctcagttgtctagaagaaataacactgtaaggaagttaaaaaaaaatttagaggattatgcttgttctcagtggtgcataagggaaaaaattgacttttttttccatattctgatttttaacagaaaagcactcatttaatagatatagggaaactagatattgctgccttttgaacagggtaggggggtttacctggttttatgaccaggaatagtatctattacatttgcttttaaataggcatgatgtggaaataccatcttggtttgagatgcatttgaggattttaatttatggaaagcacaacatatgcaatttatatttattgaatactagatgcagtatggatatttaaattgtaaaaactttacgaaaacttggaaaaggttgttcaggtttataaatagctttagtgatgcctccttctttaaatacttgtcacagcatatgaatatggtaagatcagactccctaagactcttcaggttcatttttataatgtttactttttagaacaaaacagtagctaaattacagtaatatccagttcttactgattgagacagagtggaaagaaagacatcgttgtacatcactgtcattccaaaggtacagtggaactccggatggaggaagaacttacctatcactacaacacttataaatgagcatttctcagaatgtcattctaggcaagttccactcaacaccagaccaagcaattctgtctattcacactattagcctagttttctcatacaatcagcacaagcataggaagatacttcaaaaccaaaaaaccaaggtgcaccattaatattcatttaattcaaataccaaatagttttacatagggccatcttagaaatagatattaaatccagatctactgcaatcaaagcttacacaatatgaatgaatatggtagagttgcctgttaaaaggcaatgtaatataattgctgctagaaccctacagtggggaatgaggaattttaaacatatatttgattacagccaccaaaaaagtatatataaagaaagtaaaaataaaggcatttggctggtccaagatgtaacaccaatcagtcagcacctatgattcttttacttacattttttactttttgtttttgtttttgtttttttgagacagagtatcagtctgtcgccaggctggagtgcagtggcgcaatcttggctcactgcaacctccgcctcctgggttcaagcgattctcctgcctcagcctctcgagtagctgggactacaggtgcacaccaccacgcccagctaatttttgtatttttagtagagacagggtttcaccatgttagccaggatggtcttgatctactgaccttgtgatccacctgccttagcctcccaaagtgctgagattacaggcgtgagtcatggcgcccagcctgtttttttttttgtttttttttttagtgaaatttagcctgtttttcttgagtcattttctctctgcaacagtagaggaagggcctgtatctccctaccaatgacctggtgtccttacatctaccccaagagcagggatgttagctgtgtccacagggttctgaattctacagactcatcaacatgaggcaaggaatcattgaaaaccacttttgtctcctttgggagaatgactcatctttagtatttatgtagtgtattcttctatatctacatatgcaaagctttctttgacagtaaagggcacatatgcatagtgggagaagatcagacctttacaagtgaaggaaagcaacttcagaaatgaattattttctttgctttattatttttaccaagacagagaagtattgtattgagagattatctattttcataatcaacatttgcctaaattatatttaaatcatttcactttgtactatattttcaggaattatagaatgtgttattcactcacttaaaggtacctctgtagaaataacctaaaactgcagaaggatccgaaagatataacatggtgtgtttagaaactgcagattttagatctaatgtatactgcattaataaatgatgtaaagtgtggaaaaggaaaaaaaaagactgatcccatgatcaaatattaatataaaaatttgagatcagccgggcacggtggctcacacctgtaatcccagcactttgggaggccaaggtgggtggatcatgaggtcaggagatcaagactagcctggccaacatggtgaaaacccatctctactaaaaatacaaacattagctgggcgcggtggcgggtgcctgtaatcccagctactcaggaggctgaggcaggagaatcacttgaacccgggaggtggaggttgcagtgagccgagatcgtgcaactacactccagcctgagtgacaaagcaagactgtctcaaataaataaataaataaataaataaaaataaaaaaaattggagatcaaaatattagtgcataggattcaacaataaattaaaagaacagtagtgtacatcacaactaagtgaatttatgccacccaagaatggatgaatattaagaaattttggaatataatctatcataccatattaacaggccaaagaagaaaaactgtagttatctctatagatacagaacatacatgtgacacaattaacaatctttctaacaacaaactcttgatagactatacatgtgcagagacttctttaatgatgtgtatgtgtcacaaacaaaagccagcgattcccattaaagtcaaagataattcaaggttgcttactatcaccagtcatctaaaattttcggtagatactaaccaaggcagtaagataagagagatgtagaagtacataaatattggaaatgagggaacaaaatgatgattgtaatcagataataacattgtatgctttgaatttcctgaaaattgtcttagaattttctgaaattctattagagacaataagagttctgtatgtggctagttgtagactataatatatcaataactttcttttttatttattttatttatttatttttttgagatggagtctcggtctgtcgcccaggctggagtgcagtggcgcgatcttggctcacggcaagctccgcctcccagtttcacgccattctcctgcctcagcctcccgagtagcttgggactacaggtgcccgccaccacgcccagctaattttttgtatttttagtagagatggggtttcaccatgttagccaggatggtctcgatctcctgacctcgtgatccacccaccttggcctcccaaagtgctggaattacaggcatgagccaccatgaccggccatcagtagctttcttaccagtgactagaaaagataataatgtaagaaacagttctatttataaaggaatgaaagggcaaaatatttagaaatagtgtgagcatctataaaaaaaatcttaaaactcttttgaaggagaagtcttatgtccttcaaagaagacataaataagtgaaagcatatatgtgattcttaggaagattaaatagaattaagattaaacttagtacaagatataaaatgtaataaggatgtctgaattattctaagaattccttttcatcttgattcagtgggaatttgggagtggaaacctgaataaaataactggaatttatctaaaacccgttgttctcaatgggggacgattttgtcccccagttccaacccagggaacaattggcagtgtctggagacttttttttttttttttttttttttttttttggctgtcatgactcggggctgctactgccatctagtgggtagaagccagagatactaaacatcctaggatgcgcaggaccgtccctgcagtggagagtgtcctgcccaaaaatgtcaacagtactgctgctgagaaatcctgacctagcagaataaatattctagagtaaccaggaaaattctgacaatactaatcaggggattaaccttaggcattctggaactgaagaggtgctaggcagctcagtggaacggtggacaaagtgcagaatacactggaagatttagtacaggggaaaggtggcatttcatatcacggtggataattcactcaaaaatgtgaccgagtaagtatttaggaaggaataaagctggatccctatctcattcctcccatcaaaataaattctaggaggattaaagatttaaatattaaaaaatgaaactgcaagactacaaagagaaagcatcagagaattaatttgtagtcttggccttggaagaacctttctaagtaggaacagacacagaagccataaaggaaaagatgaaaaatgtacttacataaatataagaaacttctttgcaaaaagaagaaattatttgcaatacatgtaacaaaatgcttatttacaaagagtttatacaaatcaataagaaaaagaaaaataggccagatgtggtggctcatgcctataatcccagcaatttgggaggccaaagtgggaggattgcttgagcccaggagttgaagaccagcctgggcaacatagtgagacctcatctctacaaaaataaataaataaaaattagctgggtgcgtgcctgtagtcccagctgcttgggaggctgaggtgggatgattgtctcaaaaaaaaaaaaaaaaaagaaaaggaaaaataatataatagaaatatatatagcgcccatgaaaaatacagatggctagtggaaagatactaagccttacttaagaaatgtaaagcaaggctgggtgcggtggctcaacgcctgtaatcctagcaccttgggaagctgaggcgggctgattgcttgagcccaggagttcgagaccaatctgggcaaaatggtgaaaccctgtctgtacaaaaaatacaaaaattagccaagcatggaagcgtgcacctgtagtcccagctagttgggagacagaggtgggaggatcacttgaacctgggaagtgaaggttgcagtgaactgaaatcatgccactgcactccggcctgggcaacagtgagaccctgtctcacaataaataaataataaataaataaataaataaagcaaaacaacaattagatatataatttccgctaatacattagcaaaaattaaaacagtttatcatttctggtgtcattaagggtgtaaagagccacatatggttgatgcacaaggacaagttggtaatatctatctaaatcttaatttaatctttcaccaagcatttctattatttagcacttaacggttactgatattcttggaaaaggatgccaacatgtatgagcaagttcagttgcatgattatttataatagtataatatgggaaacaacctaagtatgtattcatacagggctggttgaacaatgtgattttggtgcagtagaatagtatacaggcatgaaaatgaatacagtagatttgtgtgtactgatagggaaagatttccaatatacattactaagtggggaaaataatatggtgcatatggtataaccttaatttggttttggttttagaagtatatattaattattaaaatcaacttttttttcctggaaggatgtcagaatgattatctttgaggagagttagcagaattgatagtggcagaggaaaattttttcattttagattttcctgtgctgtttgaacattttaaacatatgcatacattgctatacaaaattaaaaacaaggtaaatacaacataaatttagacaatataaatataaactaaacttttttttgccttcacaaaatccttcctcttctacttgccttttgtagtgttctttagccatttgttggtggatttttttttattgtttgcttatagcatctgctcctttgcacaggattctaggaaaagaccttggtttcatattggctcctaaagtagacaagttcccatgccccaaggggcattggcatcctttatttgtcaaaggaaggaaataactacatatctactatacagtgatgttgggaaaaaggtctgtgaataatttatatagactgtaatgaaaagtaagtgacagttattattctcctagttatacaaattgtttgtcagttacttcatttaagtgaaattaaattatttgagttaatagggttgaatttgaaaattacattttgtttctgaagcttttatttttttaaatttattttattttttgagacggagtttcgctcttgttgcccaggctggagtgccatggcgctccacaacctccgcctcctgagttcaagtgattctcctgcctcagcctcctgagtagctgggattacaggcttgcgccaccacgcccagctaatgttgtacttttagttgagatcgggtttctccatgttggtcaggctggtcttgaactcccaacctcaggtgatccacctgcctcagcctcccaaagtgctgggattacaggcgtgagccaccacacccagccaagagcttttatttttaaatgtcagtagtcctcaacatttttgtagcacctttggacagctgatacttttgtacattgtcatgctgtccccagactgcctcatttggaataggtgaataccagtctattaggacagaccattaggagcagtggtatgcagtgcctgtctgttgcaggtgttatcacctctacagttgtatagtattgtttcggtaatcatttcaatatttgattgcattttgtctattttacatgcgtgaaaacgaggaaaatgaaagtgctggttgggattacagcaactagttgtacaggctgaacatcccaaatccaaaaattcaaaatcccaaatgcttcaaaatctgaaatgttttgagcactgacatgatgctcaaaggaaatgctcactggggcattttggattttggatttttggattagagatgctgaactggtaagtataatgcaaatattccaaaataaaaaatcagaaatccagaacacttatggtcctgagcattttggataagggatactcaccctgtagtaataagcttgggttttaaaatctcagtactgccgggtggggtggcttatgcctgtaatcccagcactctgggaggccgaggcaggcggatcacctgagatatttggagaccagcctggccaacatggcgaaaccccttctttactaaaaatagaaaaaaattagccaagtgttgtggcgggtgcctgtaatcccagctacttgggaggctgaggcagaagaatctcttgaacctgggaggtggaggctgcagtgagccgagattgtgccactgcactcgagcctgggcaacacagtgagactcagtctcaaaaaaaaaatacagttgatacaaagatggaaattatttagtgtgttagaaattagatgttcactggacttaaaccaattttctataggctcagctgtgaaggaaaagaataaaattaaaggaaattgggggacttctggcaatatatagttgatttcctttcagaggaaatttcttttcacaggaaatcaactatatattagacttgtagggggcagaattctttttatgccatgcaagacttagtttttgtacttttgacttggggacaagttttctacgatgcatagcatggtattatctatattttatttcaattgtattaattttgagaaagatttttgtcatgaaattttaatacagtgttgtgattttgaacttacaagaattaaatctatagtcagcctatattttattgcaccctttcctgggagctgatctgtcctcagggagaatccctgaaatctactccaggagaaatcatgtaatcttttggtcgtaataattatattattgtctcagccttgcctagggcgccaacttgccatctgtcatgggtggtattggaactgcttgaatggggaggcatgagcttcctcattcttttcaagactatttccagtttctggtttccaggccttatgctgttctctggggctatgccaaagtttgctccaacaatagcaagaacacagcaaaaatcacaaaaggggcttctatttttgagccctgccacctgcctgcactgtgccggcttctctgagctgctgtctctattcatgctcacaatagccataggaagagcatggttattttatctagaccaggaaccttggctttggaaaggtcaaaccagttttactttttctctcccgtgcccaccacaggtttccatatggaacatccactttttctaattggttttatttcattaatattattcacttatctgaattccaaaaaagaattctgaattcttttttttgttgttgttgttttttctatagacggagttttgctctgttgtccaggctggagtgcagtggtgcaatcatagctcattgcagcctccaacttctgggctcaagcaatcctcctgccccagctctcgagtagctgggactacaggtgcacaccaccggggtctcgccatgttgcccaggctggtcttgaactcctgggctcctcctgccttggcctcccaaagtgctgggattacagacatgagccactgcgcctggcctggattccagttcttattattctttttctccctgaggtgtcctttgtgtgtatctcatgttacacagtggtgtggcttttagagaatgaggaggttccttgtgtgcagggtcctccctgcctgccccagggtcaagtgaaaggttgtggaacccccagaaggctgtcaaggaatccagccactaggtggcagccttgtcaaaagcacccaccttctcctctgctacaagttctggttctgacaaatgtttctgactttagaaacaatgcttgtatttattgattaattcaacaaatatctttgagtggctaccatgtgcctggcactgttctaggcaaaaggactatatgagtgagcaggacaaacatccctgccttcataaaggtacatgagcaagacgtgggagagatgagaaagccaggtgaacagctggagtggtggacattccaggcagagatgacggctggcccgtgtcccccacgtcaagggagtggcaggaagaccagtggggccgcagcagagtgaacaagcagttggggaggaggatagaaagatgggggagcttgcgagtcactgtcaggactttggattttttactcttgactccactggggaacttttgcaaggttttgcacagagcagtgatatgacccaacctcattttaaaaggactgctttgggctgcttgttgagagtggacagatggggtaagcagaccagcttggaggctagggctgtggtctaggaaagaagtgacctgggctgggctggcagccatggcaccggggaacagcagctgcgtctggatatattctgaaggggagagccagctggctctcaactttcctggtttttgaattgtggaaaaatacacataatcatttttaagtgtacagttcagcggcattaagttcattcacattgttgtacaaccatcaccaccttccatttccagaactgtttcatcttctcaaagtgaaactctgtccccattaaacactcgcttcccattccccttccctcagctcccggcaagcaccattctgttctttgtctctgaatctgactgctctcagttcctcataggagtggcatcacacagtgtttgtccttttgcaaccggcttatttcactcagcataatatcctcaaggtacatccacactgtagcatgtgtcagaatttccttcgtttttgaggctaaataatatttccttgtctggatataccgtatcttctttatccattcacctgttgaaggacccttggcctatttctaccttttggctattgtgaataatgctgctctgtacacaggtgtacagatatctccttgagacactgctttgactttttgagggtatatacctggaagtgggattgctggattctcctgatggattgtaaagttggtgtagggtaagatttctgctcatgttagcagtgggatgagtgagatgaaatctgatgggccttcccaagggatgaggagtgaacgtggatctcttctggagacagcagtcggctagaaggaggttcatgtagccacatttaaaacatttttaaaaccacgagacatggaagtgcccatttagatgtttctttatatagcacacgtgggatccaaagacatgtcactattttaaactgatatcagtgttttctaaaaggcaaaataaatgtgaagggctagttttactgtggccaaactctgatgcttgcagaatctcagacatctcagatggtgatcagtaagggcaagcagtcgtgattggctcactgccaagaaactgtcagtgtcctcgctgatacctggacccctgcatgctcccagttacctgcatcacaaccaggtaatgcctgaggctccaacctgagacacctgtcctctctgacatgaggagggaataactctgtcctctctgacatgaggaggggaactcgtctaacatggaaggtaagtattcttatccccatctgacatgtgaagaagcgaaagctccaggataggtagtgttcccaaattcaaacccaggtccgactccagagttcttttttctgctactctgtttgtctcaggtagggagacttgttttcttccctcatcatctttacctgttgtagaattactattaccggtgactagcattctttgctcactatgtgctaaccactgttctcagtgtgcgatgaatatggtctcctttagtctttactacagccctatgaaatagtatccttattatcattcccattttatagatcaggagactgaggcataaagagattaagcagactgtccaagtccatgggatataaatattggtaccaggacttgcagattaggaaacaggggctgaaagaaaaccatggatgggttggcttgctggggtgagagtggaggaaggggatgttggaagttttggagttgagaggccggaaggtgggtgggtcagtttcttggatgccacagaaggaggagggccatgagccagggatgtcagggaatggggagaatggggtggggatgtgtagatggcaacagggaggggaagaggatgccaggtcctgctgtgtgaactgcagaaatggaaggtgtctgtttacagtggggaggggaacagacggggggaagcaacagtcataggtatgaggtacagcgagaccttcagtttgggaaatgtgagaaaatgaacagactggccttgggaaggcagtggtgggattcatccagctgtggaagtgaggggacattcagagagctcagcctatgggaaatgttgatttcactgtgagttctgaagggccctgaagaagtgttggggactcaagggaggggcctggggcaggtggggctgaatcgctttggagatgagaacctggaaaatcacagaatgccaggaatgagtttgttcttgttttcataattttagagaggtcatttatcaatgagtatattttgtgataaaaaaaatttcagattcggtatagatgctcctccacttacttcatcggttacttccagataaactcatcataagctgcaaatatgctaagttgaaaacacatttaatgcacttaaccttccgaacatcatagctgagcccagcctgctttaaacaggctcagaacactcatatgagcctacatttgggcaaaatcatctaacacagagcctattttataataaagtgttgaatatcttacataatttattgtattagattggtgcaaaaaagtaattgtgatttttgccattttaaaaattgcaggccaggcgcggtggctcatgcctgtaatcccagcactttgggaggccgaggtgggcggatcacgaggtcaggagatggagaccatcctgactaacacggtaaaaccccgtctctactaaaaatacaaaaaatcagccaggcatggtggtgggcgcctgtagttccagctactcgggaggctgaggcaggagaatggcgtgaacccgggaggcggagcttgcagtgagccgagatcgcgccactgcactccagcctgggcgacagagcgagactccatctcaaaaaacaaaaacaaaaacaaaacaaaacaaaaaaattgcagttacttttccatcaacctaatttactggaagtgaaaagcagaatggttgtctgggcacttgaagtacagcttctactgaatgcgcgtcatgtttgcatcaccttaaggtcaaaaagggtaagtcacaccatcataagttcggaactgtctgtattttcattttcttctattttattctacatttaattcattttcacattgtggtaggagatctaccctctgaacacatttttaagcatgtaattcaggggcaatgctgcatagcaggtccctcaagcttacgcatctgtacccactgaacgactccctgtcgcactgtctgcagcccttggcagccaccactcaactttctgtttctgtgagtttgactgtttgagattctgcatccaagtgagatcatacagtatccttttgggactggcttatttcccttagcatagtatccttcaggttcatccacaatgggacatgtgtcagagtttccttccttttaaaggctgaataatattcgatcgtctggatagccacactttgtttatccatcatacatggatggaccagactggctttcagcttctggtggtgtctgaggtaaacccagttgtgaggatgttatgaactctgcactagttaaggtgctgaattctaagcttgaggacacacatggtggtgtcgtggccctgcgtttcccgggagtacatgatttagtcagggctttggagtggggccaagggttttctgtgactttctctgttggcacaaggtgcagtgctggtttggggatggcagctctcctgggtcctccctgggtgcctgtggtatagacagtggggagctctccctgcacctccccgaagaatactgacatctttgccaactctttccatccaggtcctggctgtctctccagttctccatgtcctctcttccttttatttgggctcttcccctgaagtttgctatttcctttctccctccttccctgctctcctctcctcctttcctttttgttgagtttatacctttgtttatgccttccctcccttcctctcttcttctctcccttcattccttccttcctttttgttgagtttatgcctttgttttatacttttattcctattgtgaatgggattctttattcattgtactttgttcttattttctaacatatggactatttcacgactttgaatgtcatccttacacaggaaccatgctaatcttctctgcatcattccagttttggtattagcactgtcactgactatattttctaattagatactttaaaaaatatttagtttggaactggctcgctcccttaccatcctctcttcttagcactaatggttttcagttgattctcaggtgtcttccaagcagacagtcatatcagctgcagataacaatgccttttgtctcctccattccaggagttattcttttatttctggttcttgctgttttgtgcatgtgtgaccccagttgtgttaaatgctagtgacatcttgacttgctctcactttactgtgggtgattttggtgttttctgattaaatatgatgcagaaagttggcttggggctttgttttacatgttaagtcttctcctcctatattcctttgagttattaggatttggtcatggcttttattaaatgccttctaggcatgctgttattactttgattattgcttctctttttaccctggagtctcctccaggaaattaaagtatgtgtgtatttggtctcctgggtatttcttccatgtcacatatgttatctctgattcttgtgatcactttcattcatgctctgatttttcaaagtttatcatctaatgtgctttgctttgtatgtttcttttcttcaactattatgtttttaatctttagtctgatttctgtgctttcaaattatttcttcatgacttcttgctcaactttcatagctatcaaatcttgaatttcaaatgagaatgcaaattgcagatttttttgaaatctcccatttctaccagtaactttgtttcataggtgcatatttacttggaatcctcagctgctcccccttttatgatctgccagagctttccagatagatctagagagttttctgtgatcacctatctttacagagggaagctagtattggtccaaaaatcagaaattgagagggatactactggagaatgtgtggttatcaggtcatctttttttttttttttttttttttgagacagactctcactcttttgcccaggctgaagtgtagtggcgtgaccatagctcactgtagcctggagctcctgggctccagcagtcctcttgcctcaggctctcaaagtgatgggattataggcgtaagccacagcgcccagccaggtcatatcatttacgctctgtcgaaggaagaggaaaaatttttgcattatctggggtgaaagtaaggagggcattaaagcctgaagtgcaattttgccatttttttcttttctatgtattttgtttttgttgttctcattgttactttagtgcctgttggaaggtggccttgtcctccccttctgcttgcatgatggcccctgttcttatcagctggccatggctgtttcccttgtgtggccttctgtgcatgcaggcaaggagaagggaacactagcaggccttctgaagctgctcatggcagaggcctcaacttagtagtccagttacccttttaaatgatgacgattctgtaatgtgccctttaatatcctaaaatgaaattcaccagtccatatacattactgaaaaaaatcaatataatgctgtacctataatgtagagaagaaataaaaggcaaataatttctaatgaagtgacatatcagtgtgtaagtgctggagcctgactccactagaagacagatgcttgtacattagtggagattgctgccttaagcttgaatgctacaaatgagactgactcatgggtgcagtgttgagaattcaaataccaggcgtgttgacatcagtgactttgaaatgttgacagctcagggtaaacattttgaataaagcaaagtactgtctttccttaagttacatgatagttgcattcctagaaaattcagtgtataatagcaatgctgtgtgaaactgctttgtgtttctctgtaaaacagagttagattctggatgtaggtatttataactgtgttctcctattcaggagtgctgtcagatcacaaggagggagcaggaagcaggaagcaggcgtgcccctcatatttgcaaggcttggggcaagagtgcagcgggggccatctgtttattcacaatattctgatataattaaatattctagtaaaggagatcaagtgtcagggatttcagatgacctggtagcttgtcgatctaatgacaataattttcttactcattttcatcttttttttaatcagtaatgggtgaattttgtgtggtgaattttattttttcttcccagcttcccccaagttctactttagtattttctcatttttatcactttgaaatttgtaattcttctcaaaggttaaaaaaattaatgatattcaaatataattttaaaataatttttcttcaaaatagaaattaaagtcaatataaagggtgaaatatatttcatatttttaaattttttaatttaattttttatttttagagacagcgtcacactctgtaacacaggctggagtgcaatggcatgatcatggctcagtgcagcctcaaactcctggcctcaaacgatcctcctgcctcagcctccaaagttgctgggactacagccatgcgccaccatgcctggttaattttttaaatttttttgtagagacaggtgctcactatgttcctgggctgaagccatccttccatcctggcctcccaaagtgctgagattatgggtgtgagccactgtgcctggcctgttttgtttttttttgttttttttttttgagacggagtctcactctatcaccaggctggagtgcagtggcaccatctcggctcactgcaagctccgcctcccgggttcaagccattctcctgcctcagcctcccgagtagctggggactacaggcgcctgccaccacgcccagctaatttttttgtatttttagtagagacggggttttaccccgtgttagccaggatggtctcaatctcctgacctcgtgatctacgcacctcggcctcccaaagtgctgggattacaggtgtgagccaccgcgcccagccagatttcttttttttttagctgttgaattttgtgagttctttatatgtactagaaactagttctttattggatatgtggtctgcaaatatgttcttccagtctctcttttatcttttcaaccttataacagggtctttcacagaccaaaaattttaaattttgatgaagtccaacttgctaattttcccttctatagattgtgcttttgatgtcaaaattctttgcctagagccagttttgttgttgttgttgttgttgttttgtttgtttgtttggttgttttgagacagagtctaactctgttgcccaggctggagtgcaatggcacaatcttggctcactgcaacctctgcctcctgggctcaagtgattctcctgcctcagcctcccaagaagctgggattataggcttgtgccactgcgcccagctaatttttgtatttttagtagaaactgggtttcactatgttgctcaggctggttttgaactcctgacctcaggtgatccacctgcctcagcctctcaaagtactgggaatacaggtgtgagccactgcgcccagctgcctagagccacttctttaagattttctcttatatttttcccgaaagtcttatagttttacatttacatttaagtgtgttattcatttttagttaatttttgcaaaagttgtgagacttgggtcaaggttacttttgttgtggatgtccagttgctccattgttggaaagggtatcctttctctattgaatcgcttttctacttttgtgaaaatcagttggggctgggcgtggtggctcacacctgtaagcccaacactttgggaggctgaggccagaggatggcagcctggacaacacggcaagatcccgtctctacaagaaataaaaaaattagctgggtatggtggtgcacacttgtggtcccagctacttgagatgctgaggtgggaggattgtttgagcctgggaggtcaagtctgcagtgatatataataacgccattgcactccagcctaggtgacagagcgagaccctgtctctattaaaaaagaaaatatcagttgggcatacttttattctgggttctccattttgtgttgttgatctatatgtctgtccctctgacaatgcctcatactgttgattatggtagctttgtaatgtcttgaaatcaagtagactgattcttcctactttattattttccaaaattgttctagctagtctagttcctttgacttcccatataaatatacctacaaagaaatcttctgagatttgatagtaattgtgttgaacctgtaaatcaatttggggagaattcacatgtttttactatgttgaatctcctaatccataaacatggtatggctctccatttatttagatctttgatttctttcatcagcattttgtagtttgcggcatacaaatcctatacctgttttgttagatttacacctaagtatttattttttatttttgaggaattgtaaatgatactgtatttttaattttggtgtttgtgtgttcattgctagtatattgaaatgcaattgatatttatatgtttgccttataccttgcaactttgctaaagtcgcttattagttctaggaggattttttgtttgttttagattccttgggatttttcaatgtaaacaatcatgtcatctacaaataggtacagttttatttcttcctttttcttttgagtcgttttcttcctctgttgcccaggctggagtgcagtggcatgatctcggctcactgcaacctctgcctcccagattcaagtgattctcctgccttagcctcctgagtaggtgggattacaggcatgctaatttttttgtatttttagtagagacggggtttcaccatgttggcgaggctggttttgaacacctgacctcaagtgatccacccaccttgacctcccagagtgccaggattacaggtgtgagccactgtgcccagccaggacagttttatttcttcatttctgatctgtatgccttttatttccttttcatgtcttatcacactggctagaaagtttaacactatattgaataaaagtgctaacagtagacatctttgtcttgttcctgatctacgtggaaagcattcagtcttcttctttttttttttttttttttgcttttttgaagatggagtctcactctgtcacccaggctggagtgcagtggcacaatttcggctcactgcaacctctgcctcccgagttcaagcaattctcctgcctcagccttccaagtagctgggattacaggtgcgcaccaccacgcctggctaattttttgtattttagtagagacggggtttcactgtgttgcccaggctggtcttgaactcctgagctcaggcaatccccgcccgccttggcctcccaaagtgctgggattacaggcgtgagccactgcatccggccaagcattcagcctttaaccattaattatgtaatgttagctttcgggagtttctgtagatgctctttagcaagttgaggaatttctcctctattccagtttttctaagatttttttttttctgagaaatgtccctctattccagtctttaccatgagtggattttgaatttgtctaatgttttctctgcattgatagatgtgattatgtgacttttcttagcctgttaatatggtagattacattgactgatttttcagatcttgaacctgccttgtaccctctaaagtccacttggtcgtggtatatgattatttttatatattactgaattctatttgctagtattttgttaagaatttaaaaatctgtattcatgagggtctgtagtttgcattttttgtactgacattttctggttttggtatcaggataatactacttcataaagtaaactgggaagtattcctaacttttctttttttctggaagaaattaggtaaagtttgtgttaattcttcgttaaataattggtagaattctgagtgaaatattctctacttagaagtttgtttgtttgtttgtttgttttcatttttttttggcttttttttttggtgtgaaagggtgagtttaaaaaaatttcaaattcaaatttccctaattgttatagggctactcatattacctgcttaatattgagtgagttgtatttttcaagcagttggtccatgtcttctaaactgtcaaattttatgtgtagttatttatttatttatttatttatttatttatttatttatttgttgagatggagtctcgctctgtcacccaggctggagtgcagtggcgtgatctcggctcactgcaagctccacctcctgggttcaagccattctcctgcctcagcctcccgagtagctgggactacaggcgcccgccaccatgcccagctaattttttatatttttagtagagatggggtttcactgtgttaggcaggatggtctcgatctcctgacctcgtgatcctgccgcctcggcctcccgaagttctgggattacaggtgtgagccaccgtgcctagccgtgtgtatagttattcatattatattcccctttatcctttttgagtctgtggagtctgtagtgatatccccagtttcattcctgccattggtaatctgtatattctttctctttttttgtcagaagtttgtcaattttataattttttttcagaaccagctatttgtctcactcgtttttctctatttttttttcccatttcaccgagttctgctcttctttattatttccttatctgaaaaacagagctagtcttacccatctcctacagtgtgagaattaagtgaaatgacaaatacacgtacctaggacagaagcagaagtgtagattattttgtaaaatgtgatttttttcccccttgaactagctcccttaatagaatctcctacttaggaatcatggcagttaaaaaaaaagaatctacctgccttagtgtggtgtaccttgcccagtgtttcaggctttgctttcttaagatttttcttttttttttcaaaatcacacttgactcatgttatgtctagatttacatatacataaatttgagaggaataagaatagtttagtattgcaaactactcctcggccaccatggctcctgttgcaaacactgcagggattcatgaatattccagaaccacctgttgggatggaaagaaaaagaaaatggaaaatggaacttggcacctctggcaaagtgtaagaatgtattgtattcatcctatctgaaaccagtttaacagactgaatcttttgtgtgatctgttgtcaaagcccctcccggctttgcactccgtattcccaaccagaccagtctccactgtgggcagtggtacaactcacaaaccctcacagcgttcagacgcactcttttttgtttcaaggacaaggaaaagagatgtgaagtgtttcttggggcccagatggtgttattcataacagttgatggttagggttacaagattatatattcccatatagaatattcacacattatataagtattacttcatataatgtttatatatgtttaaatataaacatattacaaacatgtatatatttatgtaatataaatataacaaaatatagtataaaatatatattatatattccctatgtatatataataaagccacacctccaatttcaatccaaccactcagggttctttctagccttgcccctttctctgcttgtaaccatcatctctggtagtagtgagaaacatggctgccagtatcctcaatttatgtacctatttgctcaatataaccagtctcaaatccttctcccacctgccacctgcacccaactccccattccccaccctccagcctcactgaccaacccacccctctgcatgactccataacatcctttcactgccccatactcagctcccatgctgaccccttgccctgggaagggaaaaaaaattgggcacaggagctttttaaaaatggtatattataaagccaattaaatgtgcttcgtacttctagttgtttgcattatcagaaagcaagatttcctgctttctttgttgagaaaggtacttcttattgcttaggaaagttttgttttatttttttgagacagggtctcactatgttgcccaggctagtctccaactcctgggttcaagccatcctcctgcctcagcctccagagtagctgggaatataggtgtgagccactgcacctgacatgttgcctagaaatgctgaaatgggggtgaatgagaaatgctgtccctgcaggtaacttggtcaggttccagtatcccatactcccttatggaagaggagaaaagggaaagaattgtaggatcccaccatataacaagttttatgttccagaagaaagttctgcttttctggttctgtgtaatcatcacattggatggaagggaagctgaaggtctttccactgaattcatggaatattaaagttccagtccttgaacttgggtgtgaccttctgaaatgttcaagtttgtcagtggaaaacatgatcagatctcttatgctgcttttcctggctgctgacacacagtagattctcagtgttgtgtgttctcttttcctgaaagtttgtgcatgttactgagtttgccattgaattgtctttgtttgcatattgatttccacttcaaaaagtagtttaatactgtgaaagtactgttcctaagcaaattacagtacagatggtcagagtagaagtgtgtactcttgatacttccctcttccccctcaacagtggaatcttgctgggattttgtcagtgctgtttagatgggacgtttatccttatttgatcaatcccaaaaggcagcccctttgtggtagttttatactgtgaaaattagttttggaacattaagccaagaagtttgcaataaaatcaaatttgtttatgtattcatttgagacagggtcttgctgtgtcacccaggatgcagtgcagtggtatgatcatggcccactgcagccttgacctcctggtcccaagtgatcctcccgcctcagcctctggaatagtctggatggaccacaggcatgcaccaccatgcctggataatttgttatttttgtagacagagtcttactatgttgctcaggctggtcttgaactcctgggctcaagtgatcctcctgccttgacctcctacagtgctgggactacaggtgtgagccactgtgcctgatcccaacatacatttaataatctacattgcagggaattacattaggaaccatgtgtgggggaccagaagataagacttgcacgtagtcaatgcagtaatgagaagaccataagaaaagtctgtataagagagggcataggcatgactttgttctgtcctcttggccacatcctggctgtgtgaccttaagcaaattaacctaccaactacaaccattccttctgttgggaggagccaaatctgtgggagtggaaaaatcactgagaagaagccaaactctaggatgttgctgtagaaagggcctacacaccctgctgtagaaagggtcctagagtttggcttattttgtgtactggggatcactatgtctccttgcaaaccattgcactgggcgcggtggctcacacttctcacacttgtaatcccagcactttgggaggccaaggcaggcagatcacgaggtcaggagttcaagaccatcctgaccaacatagtgaaaccccgtctctactgaaaatacaaaaattagccaggcatagtggcgcacgtctgttaatcccagctactcaggaggttgaggcaggagaattgcttgaacacgggaggcggaggttgcagttagccaagatcacgccactgcactccagtctgggtggcagagctagactccatctattaaaaaaaaaaaaaaaaatctgtcttttcaaactctagtcttttatcaggtaaacattttctaagttttattcattttttttggaacaagtaagacagtttacttattcaaaatgtaaagggttacagtgaaaagttttgctcctgcccctttgcccagccaccaagttcacccaccagtggtggggaatgtggtatctttctagaactattcagtgtgtctggaagcaaaaggatatccttttacctttctgtatgcaaatagtaacgtaaatggacacaccattctgcacgtgcgcattttctcttttcagtgtattttggaaatcattcctatcattccataaagaacctcctcgttctggtccccatctctctggcacttgttttatgatttctcagtggttactgatagcagttcacagcctcattcccaagttatctccgtgtttggggtttaatttccctgggccaggatatttacattcatgagatggtttccttggactttagtttcctcccactaaggtttgagctacactttgcaaatgggcaaagaccatttttggatgtatatgcctgagggaagacagaaaaacaaagctgaaagagcatccagagggtttgccttcaccatcggaaaccactcagctccttttcagggctagcttttcagactgctttccgagatttctgcccactcctgtttggccatggccgtgtgccctattttcagtttctatatatgccctcatgttttcctgagcacatcaagaacgcctgcacggttacactggtttatttaggaaccgtcccctttcttcttcagtctgtcagttactcatttgaggtcagactcacaattctgcgaatgtcttagcctcttggaggagcatcgtgtgtgatgttggacaagctgcttagtgtctctcagctggtttcctcatccataagatggagttaatcgtgcccattacagagaattgtgacaagcaaatgaaatgacacatctgcagaactaagagcagaaactgaaatatagatatttttataaaatgtgatttttccctcaaataatcttctttaacagaatatcctacttaggaattatggcaaaacaaaaacaaacttaaaaaaatccacctgccttagactcttggtcatcttttaagattcttcaagttttgctttctttttttatttcctttaaaaggtttttttaaaattaaatctttattttatttattattttgttttttgagacagagtctaactccattgcccaggctggagtgcagtggcacaatcttggcttactgcaacctctgcctcccgggttcaagtgattctcatacctcagcctcctgagtagctgggattacaggtccatgccaccaagcccagctaatttttgtattttttactagagatgggttttcggcatgttgaccaggctggtctcgaactcctgacctcaaataatccgcccttccacctcccaaagtactaggattacaggcgtgagccaccgtacccagccctttattttattttatttttatgcaacagggtctcactctgttgcccaggctggagtgcagtggtgcaatcatggctcactgcagccttgaactcctgggctcaagcagccctcccaccccagcctcctgagtagctgggactacaggtgggcaccttcatgcccagctaaattttgtttgtagagatggggtgtcactatgttgcccagggtggtcttgaactcatgttcaatcaatgttcctgctgtagcctcccaaagtgctgggattacaggcatgagccaccaggcctagcttgagtcttaatttttttttggagtttccatacaccctctgcccccacacatgtacagcctctcccattatcaacatcccccaccagcgtggtacattgacatgacagatcattgtcacccaaagtccatagtttaagtttgggttcacttttggtggtgtacattctgtgggtttgaatgaatgtataatgccacgtatcggcaattgtaatatcacacagagtagtttcactgcccccaaaatcctctgtgctctgcccgttcatccctccctcatccctagtccctggaaaccactgatctttttactgtcccatagttttgcctttcctagaatgtcacatagttggaatcatacagtatgtcaccttttatattggcttctttcacttagtaatacacatttaagtttcctccatgtcttttcatggcttgatagttcatttctttttagcactgaataatattccattttctggatgtacaacagtttatttatccattctcctactgaaggacatcctggttgcttccaagtgttggcaattatgaataaagcttctataaatactcgtgaagctttgctttaagatgacatgtttttttctccccaagttaccatcacttatcaaccagttcttttttggtcaatattaaatttttccatttttggctccaactagtaaaaatagggccagattttgactaatagatgaaagaatattctggttagctgcagcaattcagagacaagcatgttgctccaggaagtaaggaactccatgtgcttgctagagaggtactcattctctacaagtggaggagctatggagtgacaggattggaagactttcatcaaagtcctttccaaccctgaaggggctgctattaaggtcaaagacctgttcttgggtacattttcttgtatcctcccatgtgggaagctctgttccaagcctttgggttacaagatagacagaagtccttgatgattcccaaacctgcatctcggatcccaacttgcccgttgtactccagaaacactcctcccactgtttgctgaaaatgtctggggaatattctgcatgtgtattcattcattccttcaatacatatttagtgtctactatgttccaggcatctttctgggtgctagggatgcagcagttaacgacaacaaaaaaagtccctgctctcatggatcttacatttcattctcaacatgtcttaaccaaacccatcatcctcgtttcattatagagttgtttaactgctttctctagcatctggatttgtcctaactgaagtggcatttctcagtcctccagatacattctagtgttatctttattaacttcctttctctcaacatgtaattgtcatctacagttgcatcttacacttcttatttatttatttatttattttttgagacgaaatctcgctcttgtctcccaggctagggtgcaattgcgcaatctcggctcactgcaacctccgcctccccggttcaagcaattctcctgcctcagcctactgagtagctgggatgacaggtgcccatcaccacgcctggctaattttttgtatttttagtagagacggggtttcgctatgttggccaggctggtcttgaactcctgacgttgtgatccgcctgtctcagcctcccaaagtgccgggattacaggtgtgagccaccgcacccagcccacttctttttatttcttttgcattcccctgacttcacccaacacagcatctcttacccaaagcacagtagcttcctgacttgagttgctgctggtggttaatgcttactctctcgtcctatgtgagtaggatcattttcggcccatcaattgaaaaagttggctaaaccagggaaacctaaaaaaattaaactatacttttaaacattttattttcacccaaaacatataactgcacatttgttcactcatctttagttatagagccaagacattgtcttacagtggtcttgttgattgaagtttttttaaacatctttccattcttatatctcctatgatttccagttttagtttttttaaacatgagaaagaacgaaaatacttaagaggaagattggatactgaatcctttcacatgtttgcaaatattcctctattataattgcttcagccatttttagtgactcatcttcattgagtcttttcaaaccattcagcatgtcttttgaggaagcgatatctctccctctttgtactcatatttcactagttaatgtacaaagttatggaaataaatttgcaagtacaactagcataaataggtttgggaacaaatatgcttgactcttactatgaagacaacccacatgatgggagcatgagtgcccaggtgtcccagagaggagactaccagccaaaagtgttcatcttgccaagggtgtcagtcagtgtgtcctgtaaacatggggtgcattggttattttggtgaattgattatctgtaaaatgttcagtagagagtgcataagagagcaacttctgtattaccagagtaatcttcctaagccacagctgtcatgagatcacttctctgctcgaaaaccttcaagcactcctcactggttgaggggccaagggcaacatcttgccttgtgattcattgtgatctatggctgtcttacctccctcccccgttggtgccttgactgtgaccttttcacagtcactctggtgaacaacgacggggcctgctgccggggccttgcttgtctaggctgtgcatgtccaagccaagcccctccctccctgctgcccccttctctcctcctgccactgcagaccttgatggatatgctgttcacctggaaaggacccgctcatagtagcacctccttcaaaaagcgtttcttgagctcctttcaacagggcatgctttttcctttaaaaacccttctgcagcaccccatgtgtatttgttaagtcactcccatatcctacctatactgcttctcctgcctaataactctctgttgccgtgagttgaacccagctcactggacctgctcgctgctcattcagcaagcaggcaactcctgagtatgggcgatgctgtcccctttatctcctcttcttcaaagactgtgtgtctttgaatgcgagctcaccaggctcccccaggcttcagtcatgctaactgattcagagcgaggacatggctcttttgaggttgtaaataatacatcaagtcttgaaggcttatctgcttgtctcccttgactttttcaagaagcagctttattgataataatttacataccataaaattcacccatttacagtgtgcaatccagtgaattttagtgaattgactgagttacaaccatcaccgcagatgagttttaagatattcctgtcactccagaaataccccatgctgctgtttccagtcaatatctgtttccaccaccagctccaggcaaccactaatctgttttttatccgtatagctcctcccttgactctccctgccacttcctcagaattggagtgttttctggactaatgtgtgtgctatttgcctaaggaacttttcttccgattcagttacgtaactttgtgatcttctctttcactcattctccccatgttcaagtttctcttggttttctttgttgtgtgaacctagtctctgttcaccgagttggcctttggcttattaagaaaactgagctttttcccctctttcagaatatggaaaacttgaatagtgtcatgtacaaatattgtagtgtcatgtacaaaccagatgctgaatgttatctaccgaatgaaggaatctgagccctgctaaggcatgggaaatcttgtcttctgttacattcagcatagtgcgtgtaaagtcactaaattattattttggttaataaatactttttattttttggtaaggaaaattacattgtttttattaagatgattcatgcttgatagcttaaagagtacaaacaaagtaataccttaaaaagaaaagtataatatgatccagtatttccacttctggttatatacccaaaataattgaaagcaggaacttgaaaagatatttgtgcgcccgtgttcttagcagcattgtttgcaataactaaaaggtggaagcaacccaagtgtccatcaacagatgcgtagatcaacaaaaatgtggtatatacatacaacagaatgtcaggccagccttaaaaagaaagaatttctgacacgtgctacagcatgtgctacctcaaagacattatgctgagtaaaaggattgtgtgatcattcctatgagggacctagagtcaccaaatccatagagacagaaagttgaatggtgattgccagcggctgcgggaggagggagtagagagttattcttttataggtaccaagttttggttgtgcaagatgaaaagagttctggaaatgggggtggtgatggttgtacaacaatgtgaatgtacttaacacctctggactgtacactaaaaatagttgagatgccagcctggctgacacagtgaaagcctatctttaccaaaaaaaaaaaaaccaacaaaaattagccaggcatggtggtgcgtgcctgtagtcacagctactcgggaggctaaggcaggagaatcacttgaacctgggaggtggaggtttcagtgagctgagatcgcgccactgtactctagccttggttgacagagtgagaccctgtctcaaaaaaaataataattgagatggtgagttttatgttacatatattttaccacaattaaaaaataaaaataataaagggaataacagaagaagaacagagaagaaagttaaagtactatctgaaacaccacgtcttagaaacaaccagtgtttgccacaggaatattctttataggaaaaaaaaaaaaaagcctgggcaacgtggcaaaaccccatctctatcaaaaatacaaaactttagccaaccgtggtggtacgtgcctgtggtcccagctactcaggaggctgaggcaggaggattgcttgagcccaggaagtcgaggctgtagtgagctgtgatggcactactgcacgccagcctgggtaacagagcaagatcaagtttcaaaaaaaaaaaaaaaagtccgagcgtggtggctcatgcctgtaatcccagcactttggcaggccgaggcgggcagatcacttgaggtcaggggtttgaaaccagcctggccaacatagtgaaaccctgtctctactaaaaatacaaaatttagctgggcatggtggcacgtgcctgtaatcccaggtacttgggaggctgaggcacgagaatggcttgaacctgggaggcggaggttgagccactgcactccagcctgtgcaacagaggtaagactctgtctcaaaaaaaaaacaaaaaaacaaccagtgtatggggatggttttctaagcatctctttcagcggtggtaccttcgtaacgacaaataccagtacaggttcagagtagggggaatccattcagagtccttgagaggaggcctgcagcagggatggggggctgatcacgcaaggcaggaaagttgtctgtacctgcagcagtgagtgcctgataggcctgtggggcggcttcagtgcccaccacagggcgtgggggagcccaggcaacagggagcctccttctgccattagtggagggaggggcctaggctgctgaggttgagcttcccaagggagttctgtagaggagagaataaagagcacactatgtgagttcactgagagtcctcgctttgagaaaaggtgacacactcctgggactcccagaaatactgcgggaactttgcagttgggacgataagtaaatgactagggccagaaaaatattatttaatactgtttttttcttttctttttttttttttttttttttttttttgaggcagggtctctgtctgtcaccgaggctggagtgcagtggtgcgatcacagctcactgctgccttgacctcctgggctcaagctcaagtgattctcctgcctcagactcccaagtagctgggactacaggtgcataccatcatgctcggctaatttttttactttttgtagagatgtggtctccctgtgttgcccaggctggtctcgaactactgagctcaagtgatcttcttgccttggcctcccaaagtgctgggattgcaggtgtgagccactgtgcccagccagtactgttaacatgaccccattggtacccctagacttgttggtctagggaaacatgagacacacaaaatacataggaaggtgttcagcctataattttcctttatatataagtgaacttcaaaatcttgaaggccaatgatgactttgatttttctgttttagcaatagggtcttgctatgttgcttagattagactggagcttctgggctcaggcaatcctcctgcctcagcctcccaaatagctggggctactggcatgcattactatgcctggctcaatgaagattttttatatttgtaccaaggtctcaaagaaggcagtgggcagataatagaggtgtcacacgctaggaggatggatcacctaatgaatcagtggctgagacaagtacagaggttttttttgtgtgtatagttttatagtgattgatatcagtcttctttcatttagattatagcaaggttattcatatttaagttaagccctattaaggctaaaaacattctaattcaagaaggatgttcaagattctctccttaaagatattacatattttatagtttgctgtttaaagaaactatttgttttctgtgaatcctgaaatgttgatttctctttgaagattctgtgtccagcttctactggagacaaagtggtttagtgtaggaagaacgagtgcttcagtggcaacaggcctgcattaaatttcagctccctacttttaatctatatgaccttgggcaagatagcgtaatctccctgaacctcggtctcttgcttgtaagtagagaaaaagaatggctactgggtcagaccacaccggattcgctggattgtaacactgaggaagtgtgccaagtgcgtaacagaatggaaagtaggtaactcagagggtgtttaattcaggggttcggcatgccaaaaagggtgcaggttctttccatctttttggtcgaccaccctgattgtgctggcttggccctctggccagctcccctcgtcatcacgagataactactagagttctggcaacctcaaaccgaggacagagtcccatggaagaagaaggtttcagtatctctttaagaataagagaactttccccagccttcctcccagcagacctcccttcaaatgtttttggtcagaactgggtctcatagcatccttgacctagtcactagcaaggaaaatggaatcaccaggattaacgtaggctgtgcatgaaggatctactactcagctaagaacaggccaccttctctcagggccagctccctggcaggcaggaaggaaggaaggaagatgtgggaaatggctgataggtagtccacagagactgccacacttgttttgtggtgttaatttaaggtctagtttattatttggatcaggaatgtttaaaaaattaatgggctttatcttttagaggtattgtaggtttatagaaaagttagtggaaagtatagaaagtttccatatataccccctcaccatcacctccagactcccaagttactaacttcttgcattaggatggtacatttcttggaattgatgagccagtgtaagtacattgttattaactaaagtccatagtttatgttagggttcacttttggtggtgtacattctatgggttttgacacgtatccaccattacagagtcatacagagtagtttccctgccctaaaaatcgcctgtgctccacccgttcatccttcctcctaagtgcctggcaaccactgatcttactgtctctacaggtttgccttttttgtcagatagctggaatgatgtagtgtagctgaaaagaagtggccttttcagaccggcttctttcacttagcagtatgcatttaaggttcctccatgtctttttgtgtcttgatcatttctttttagtgctgaataatattccattatatggatgtaccacagtttatcattcaactattgaaggatatttttgttgcttccaagttttggcaattatgaataaaactgctataaacattcatgtgcaggtttttgtgtagacctaagttttcagctcatttgggtagatatcaagaagctcaactgctggatcttatgataagaatatgtttagttttgtaagaaactgacgctgggcatggtggttcacgcctgtaatcctggaactttgggaggctgaggcgggtggaacatgaggtcaggagttcaagaccagcctggccaacatggcaaaaccctgtctctactaaaaatacaaaaaattagctgggcatggtggcgggtgcctgtaatcccagctacttgggaggctgaggcaggagaattgcttgaacccaggaggtggaagttgcagtgagctgagattgcaccactgcactccagcctgggcaataagagcaaaactctgtctcaaaaaacaaaacaaaacaaaactgacaaactgtctttcaaaatggttgtaccattttgcatttccaccagcaatgaatgagagtttctgttgttctacatccttgccagcatttggtgttgtcagtcttttggattttcaccattctaataggtgcataacagtatggatcgtgatttttttttttttttttttgagacggagtttcgctcttgtttcccaggctggagtgcttggctcaccgcaggctccgcctcctgggttcaagtgattctcctgcctcagcctcctgagtagctgggattacagatatgcaccaccatgcccggctaattttgtatttttagtaaagacagggtttctccatgttggtcaggctggtctcgatctcacaacctcaggtgatctgcctgccttggcctcccaaagtgctgagattaacaggtgtgagccaccatgcctggccatggatcatgatttaaaaaaaatactggcacaaggaaatttgaactctggctatttggtaaaaaattattgttaatattttttagttgagataatggaattgtgtgtgtgttttttaaagagttcttatctttagaaatccatgctgaaatatttaccaatgaaataggatgtcttggatttgcttcaaaataattgaagctagaggaagaagtgggtgatagatgaaaaaaattggctctgagttggaaactattgaaactgagttgagaggcatatggagggccattatattagttctctttagttttgtgtatgttgcggcttttcataaaaggtttttactaattaaagtttaatcatgtattatttaaaaatgatagagacagggtgcaatggctcatgctataatcccaacacttcaggaggccaagtagggaaaattgctggaggcctggagttcaaggccagtctgggcaacatagtgagatcccatatctataaaacatttaaaaaagttagctgggtgtgatgacatgaggctataatcccagctacttgggagggaggctgaggtgggaggatcatttgagcccaggagttcgagactgcagtgagctataattgggccactgtattcaagcctgggcaatagagcaagactctgtctcaaaataagaaaaaagatggacactttggtgtttagtaaaaattaggaactgtcttctggtcctacctttgcttaagtttagttcttaacagtattctgaggaataaatgaatatttgttgaatatatatgtattagagtttattattcaaggaatcttcctagaaactgaagatttttggtaatatgataaattttacttgaaattattatttttagagatagggtctcactctgtggcccaggctggagtgcagtagtgcaatcatagctcactgcaaccttgaactcctgggctcaagtggttctcccacctcagcctcccgagtaactgggactacaggtgcacactaccacacttggctgattttttattttttctagagatagggtcttgtgctgtttcccaggctgaattttactttaaattattttaacatttatgtatttttccaaataaatgtatttttaactcaaaagcaaaaagcagtacatgtgcactagaaaaaaaaaaaaaaggacaagcaataaaagaacttatataaaggacatcataatcttgcctactcagagagggccactctcaatcagtgccttgaggtataattgttgaaaccctttccatcttatccaggtatctgtgtctatatagtttttgtttatgtacaaaaatttagaattgtattcttttttttttgagacagagttttgctcttgttgcccaggctggagtgcagtggcgcgttctcggctcactgcagcctctgcctcccaggttcaagcgattctcctgcctcaggctcccgagtagccgagattacaggcacctgccactgcgcccagctattgttttgtatttttagtagagacggggtttcaccatgttggccaggctggtctcaaactcctgacctcaggcaatcccgcctgcctcagcctcccaaagtgctgggattacaggggtaggccaccacccctcgcccagcggattacattcttaacatatgtactgttttgcttttaacttagtatctgacacatagctttagagactgcataggaagccatcatatagctgtattatattttattaaacttggacatttgtgttgaacattgtaggtttttccagctttttgctattacaaacagaaaggaggcaacgtgcagttgttaagaacacaaactctggagttaaatggcatggtttctctgcagaaaagggtgaatgtagcaggtctgggactgctgtccttagaaaggctgcttccaaggttggcacttggctcgtgtcagggaacttggatttcggaagggttcctgccaccctaattggtaagagtggctcactgcataaactgtgcaaacactgtagtttatgctgaactcctgttttccttccaggagcctatgtgatcgcctggtaaaaaccctggatgctaagtctctagtgaatttccctggcagacatttcacacgtgttgtcacagctcattgctggaagaattaagcacaccctgaatgactacactggggggaaattcatggaagcttgcacctagtttcctctggacttggtcttgtagaccttttcccttttctttgtatccttttgctgtcatatatcatagctctgagtgcaactgtgtgctgagtcttgtgagtcctttcagagaatcaccaaaccttggggtggacttggggacacaggtttaaatcctggctctgctgctttctagcggagtaaacttaggcaagttactcaccctctcagtcattttctaatctttaatttgagttaaaaaaacagttttgttttataaatcgaaatatataatgtacttagaatagtgcctggcatgtaattatttctcaacaaatgttaagaattatcttgcaagctagatgtttgtgtatatttgtaactatttcttttcttctttttttttctgagatggagtctcactctgtctcccaggctggagtgcagaggtgcgatctcggctcactgcaagctccgcctcccgggttcacaccattatcctgcctcagcctcccgagtagctgggactacaggcgcccgccaccacgcccggctaatttttttgtattttttttttagtatagtagagacagggtttcaccgttttagtccggatggtctcgatctcctgacctggtgatctgcccgcctcagcctcctaaagtgctgggattacaggcgtgagccactgtgcccggccttttttctttttttttttgggacggagtctcagctcatcacaacctttgcctcacaggttcaagtgattttttctgcctcagcctcccaagtagctgggatcatccctgcactttgggaggccgaggcgggcagatcacctgaggtcgggagttcgagactagcctgaccaacatggagaaatcccgtctctactaaaaatactaaattagccaggtgtggtggtgcatgcctgtaatcccagctactcgggaggctgaggcaggagaatcgcttgaactcgggaggcggaggttgcagtgagccgagatcgcaccactgcactccaacctgggcaacgagtgaaactctgtctcaaaaaaaaaaaaaagtgctgggattacaggtttgagccaccgtgactggcctgtaactatttctttcaaataaatttctgtaagaataactgctgagcttaaggatatgtactttttttaatgtgttctggtcatagtagtaaaatatatttattaagacagatatttggtatagaaaaaaagtctttcctaattctatatttcagatatagttatttctaataatttgctatatacatgtcaaaatttatttctacacatattaatatggacagtagaatatagaaatttttaataaaaatgggaccacatatatattattttattgtttatgcctgtatataagggatctttatattcagtgaagttccataaaaacctttttgtcttccttaaaacgcttagattataggtgaagtaaaaaatatgtaattataatgtccaagttgtcaacttagttatacctttacatttgaaattacacattatagaaatacagtaatttagaaattacagacagtccctgacttatgatggtttgacttaggattttttgactttgtgatggtacaaaagctatactgtacttcaaattttgaattttgatcttttaccaggctagtgatatgtggagctacacttttttgtgatgctgggcagtggttgtgagccgcagctcctagtcagccctgcaatcatgggggtaaaccttcaacagtactgcgttgtcagcatttttttgaatattgtttgccagcatttttgcatccatcctgtctacaaagcccatctcgacttagaatattttcagtttacaatgggttattgggacgtaacccatcataagttgaggagtgtctgtacactgttgctttttttatagtcatcacaggcgtctttgacatgtcaccctgtcaccatgatcatcagagccacttttaaggtttacatcagatacacagcacatcagcttcacttccgcgtgttgcttgattccactggactctttgattccacaggaaattttatcctgttcatataacattcaggcagttggtttttcatttgcccaggatgtgtgactgccacaacctgactgatccctgaactgctttttaaaattatccatggctgggcatggtggctcatgcctgtaatcccagcactttgggaggccaactcaggtggatcacctgaggtcaggagttcgagaccagcctgaccaacatggtgaaaccctgtctctacttaaaatagaaaaattagctgggcatggtggcaggcgcctgtaatcccagctacttgggaggctgaggcaggagaatcgcttgaacccgggaggctcttgtctttgacatgctagttctgtgggagaaaccccagctgggcctggtggctcatgcctgtaatcccagctactcgggaggcagagggaggtggatcacttgaggtcaggagtttgagaccagcctgaccaacatggtgaaaccccatctctacaaaaataaaaaaattagccaggcatggtagcatgcacctgtaatcccagctacttgggaggctgaggcacgaaaatcacttaaacccaggaggcggagattgcagtgagctgagatcacgctattgcactccagcctgggcaacagagcaaaactgtctcaaaaaataaaataaaataaaataatacaagcattgacaggtacagaagtaccatgagggagacagcattgaattctgtctgagatgtgcaggcagaccaaaggggggtgataacagagcaagaatttaaaagatgatatatattactctgcttcagctgccataaccaattgcacagactggatggcttaaacagcagaaatttatttctcggagtgttggaggctggaagcctgagttcagagtgccagcatggctgggttctggtgaggagtcttcttggcttatacatgccaccatctcactgtgacctcacataacagaaagagagagagagaaagatctcttcctcttctttttttatttttatttgttttattttgttttgttttttgagatggagtcttgctctgttgccaggctggagtacaatggtgcgatctcggctcactgcaacctctgcctcccgggttcaagcgattctcctgcctcagctgagaaggtgggactagaggcacgtgccaccacgcctagctaatttttgtatttttggtagagatggggtttcaccatgttggccagatggtcttgatctcttgacctcgtgatctgcctgcctcagcctcccaaagtgctgggattacaggcgtgagcctccgccagcctcttcctcttcttataaggccacctatcctgctagattagggccccccacccttatgacctcatttaaccttaattacctcctaaaggccctgtctccaaatactatcacattgtggggggtagggcttcaacatgaatttaggaaggacacaactcagttcacagcagatgaataagcatttgccaggcagctcagttatggacgaggtgttgaaaccgacggaatatagcagatatgaaagcatagaggcctgaaacaatagggtgtgttcagggagctacagctggctcaacattgctgtaatataagttgggagggagaacttctgaaagctgaggctagaacaataggggtggaggtggagcacatgattatgaaggaccttggtatactaagcttagaaggacttcatcttaagggtagaggggagccacaggaacttctaggcagaggcatggcgcagtcagatttgcatttttgataattcaggtggaggagcaatttaagtagcagcgaaagtggaagtagtaagttagttgggaagctaatgcagtagcccttgtgaagcaaagatgcagcaaagacaagagaggcaaagtctggaaaatgttaaggtgatgaaatgtgcaggacttgactagatattttaaatgtgggaggtgagagagccataggagtccaggttgggttggggtcttacttgtccagtttccataaagagacatgttaattacttgacattttacagaattagtatattgactcattgatttccaaaactctttgaataagtatgtaactgttctgtagattgaagttgtgtcactcttaccatgatcacaaactcaggctctgcctatcattttggaactatttggggaagtcgaccatcttttctgggctagttacctttttaaaaggggagggagttgcacttggtgtcatatgcatttctgctctaacattgtttcctgctatttattttccttagtatatttgcttgtacatgctcagtattgtgctgtgttttatagattacagaaataaaactgtgactcttgtctttgacacgctagttttgtggcagaaaccaactcatggtactatactaccactaaaaagaagtaatgtgtatttaagggctaatttgtgtctgctgcctgcagcctatacattggttcattcatttgttttcattcatttgttccgagtctctgtgtttataaagtttacactctagtggaggaacaataattagtaaacatgtagtatatggaatggtgatcagtgtcacagaggccagcaaagtaggagagggtgtgtgctgagggtctggcttactatttaatgtggtgcgatgagagaagcccccttagtagggtgacatttgagcaaaggcccagggagtgagagagggtgagacataaggtctatgcagtgtaggtgtcgggaggaagaatgttgcaggcagagggaacaccaagtgcaaaggccctgagatgggaacatgccccgcttatttgaggaacagtgaggaggccggtgtagcaacagcaatgtgagaaggggaaggtgagttcactgatgggggaagaggaggattattcagggccttggaggccattgtaagggctttgactttccctccaagtgagacagaaagacactggagcgttgcaagtgggggtgtgacatgatttgacctaggctttagaagcatcactctcactgtatgtgcagaatggactataaagaggcaagggcaggagaagtgagactggttaggaggcagttgcagtaatcctggcaggagatgacagcggcttggatcgggggtagcagtggaggaggtgagaagtgctgagatgtagggctatttatgatacacatactgacaggcgttgttgagggacgagatgtggcatgtgaaaggagtcgaggtttctggcctgagtcactggaagaacggaactgccacttatggagatggagaggactattaaaaaacctaagtggaggtgtcaagagaaggtgtcaagaaggtagttggacaaatgagtctggagttagaagagggaaccagcctggagatatgtagatggtatttgaaagccacaagttggtaaatcaaagaccaagagagtatataggaaagaggtctgttggctgagctttagtgcccagggtgggtcaagatgaggaggaaccaacaaaggggactgggaagaggcttctaggggagtgagcagaaaactaggagagggtagcatcctggaaccaagtgaacacactgtttggaggcgttaggagtaatcagtggtgtcctacgatgttgatgcgtgacacctgagaatggaccgtagtgttcaagtgatgcacgagatagaaccagtcataccactaatggtttttttagtcctaaatatttttactgcaagatttcgttgttctaagtgttttcactgtcagatgaaggatgaaagtcgttcagggtaatttccattttagtaatttccgacagcggcagaacagtttctacttacgattggtatgcatttttattattagccatagtattcattttgggtgagtacgtctttgttagcgttatttttcttcaccacctcctcgagttgttcatccattcattcattcacccaaagaaatgcttattaagcgcctgtcctgcgctagtcctaggtttctcttgtcctgataggtctagcttcacacgagcaggattttgcctttccggcggcactaggcttccgcctcaccgcagtggggtttttccagcctaccttgtgcagctgcggttctcagcatccgcgggcggaggcctgcagccggtcagccggtgcgtcccgcccacggcgcggggccttctggcagccaagaaggaaatacagatgaggtgggcggacagtatgcagatgacgggggcgggccgcgcctggcgggcggtgtgcagttgaggtggtccggcaggatgcagatgaagggggcgggccgcgagggcgggcttgatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagtactctgcacctttttattttatcatatcataggcatccttccaggtcaatacatagaaatctatcttattttaagagcaacatgaccttccataggaaggatatgtcctggaatattaaaatattgtcttactaatgcacaacaaggttataattttttttttatgagtaatgctataatagcagtccttattcatatagtcctatgtagttgtggttttatttttatagaatgggtttttcaaaatactattgctgctctaaagtatatgcacatttttattttaatagatgtctccaattactcacctgagtgctgtgacatttcactcttgaacatgcccatctgtatacatcctgagcagtagtggagagccttgatcatatttttgccaataggataatcaaaaaatactatcttattagcactttaatttgcatttcgctgagttttttttttttttttttttttttttttttttaaagacagggcctcactctgtcacctaggctggagtgcagtggtacagtcatggctcactgcagcctcaacctcctggacttgagcagtcctcccaccccagcctcctgagtagctgggactacaggggcacaccaccatgtccagctaattttttttttttttttttttttttttttttttggtagacacgaggtctcactgtgttgcacagagagactggtatcgaactcctgggctcaagtgatcctcccaactcagcctcccaaagtgcagggattacagccatgagccaccatgcccagccctttctaagcacatctttgtatgtttactaaccactgcattttctcttctaagaattactagttttgcaacttttccctgctttttcactgagctgattgtttttttctcatcagcttataagtcagtattttattagggatacggttgtatcccctatattatgagcctttatcatatttttcatgtgatatggctttatctttatcatagaaaattttatatttttatgtaaactgttagtgttttcctttactcttttttttaagattccttctccccagtattatacaaatgtgctattaaatgtcttcatctacttgatgcacacacatatgcaggccatttgatccacctctctttatttaatctgatgtgaggtgtggttctttttctcccactgggtagcactgtttattaccagagtcatcctttgtccactgaattgaaatcccacctttacatggtttatgtcatccacattcagagagacctgccctagatgtgctcccatttctttctcttttgagttagctctgctttaaaatattcatagattattagattgcttatattacttttaactcatcctttcatttaaaatttttattttattgaattttaaggcagacagtatcagtgttgaactctgtttccagtcatgaatttacaaacgccagtcctctcttgagtgcagtttccccttcactttgtattatgaactgtttgcatcgagcagggcatgattttgcctgtcaccttctcttgctgaagcagatccaggtgtggcagggcctgacgtttgccccaggtccgtgtctgaattctgctcagatccactgcctttgcctgacagtgcttctgatcttcttctcatgacttaaacgtgttgggaggctcttgaaggtacatttgtattacatacttggaggtacagaagcccaggtagagtagagaagggtgagtgcctagttgggaaattcacctgtacccagtttcttctctgcctggtgagcctggaacgcagagccagctctctggatctctttgcgtgcccctcatccattttaggtgcacactgtggctcttcctatcctgccccttgtcactactgccctttatgcctagggtaaaccaaccttggccttctcggatgtaaattcttcttgttcctgatcctttgccaaaacgccgtgcatctctctgggcttctcatgctcctctccagccttggccctctagggtgggggacattagttggggttttcccatatctccattttctttggaagggaattgagggaaagcccttggtattgtattttcattcccccgaccgtgtactctctattagcagaaattcttcagaatctaagccacgtcaatgatactcgactacaggacttttactatttgattcttattgttgggatttgtagattatgatgctggtgttcaaattactttcttatcctgtttgtttttattgttatatatgcttttactgaaatttgaaagtgaaatttagaagatattgtttgacacctaagagacaaagtacttcataatttctgtcttcaaatagagtgaaaaacttctgttagatttgttttatgcaaaataagtatttagaaaaaattacattccaggcaagggcatagaatgagcaaaggcacagaggcagggcataaaagtaaaaaacttcaggtgaatagtccaaaactagatgggcagaggggagtcttgggagattaactgaaagacctggggttgggctttgttcaggtgttcagtaaagagaccggcaggcgtgagcatgtggttgacatgcgacccgccctcttcacaaatattaatctgccaattgtgaaggtagcagtggtgccatacaacactacccaaatggagttaacctttgaatactttaaaaatcatcatgtacaggagctcacctgttcctggatcagaatgaacaatgacataaagtgctgtttttaggaagtaaatgctgtagaccatgactgacatttgaaaactctgttctctaacataacaaggaaagcagcaaattagagaggttaaataaaagttttaaagggaaataattagagacatgtatgtatatgtgcttaaatgacaaggtgaggcatggaaggcagaccgacattcagtgaggagggccatgtgccttgctgtgctccatggagacactgtctgcttatggagtgtgcatcacctgctgtgtgtgacacagcatcaggcggtctggcctgcaactgttgttctctagtatctggcctgcaactgttgttctctagtatgggttgccgccttttaagagcagattattgtataaagataggaacactgaaataacttggtagtattttttaaatgtacttaaaatttaggaagaaataccatcagtattatttctagaaccttgtatatctctcacagaacatttatgcattatagaaaatttgagaaatgcgtggccagagctggatttgcaccccagtttcaccattcatgaatcatgtgaccatggtcaaattttcctctaaaataagggataataatatctagttttgttgaaaattaaattagataatgcttttaagacacatggtactgtgcttggcatatacagtggagttatacacattcatatttgttttgctgaaattatcgattattatcccagttttatatgctgggagcaggtagaatacttgcttcatttttgttgttttaagcatggcccctaaacactaagcacctatttaatgtgtgatgtaactgaagaaagagccaatcatgaaatgctggagggaatgcaagtatgtgagacttctggagagttggtgtgtttgtaaacagtcatgtttacaaaagcatgtacttttgagtgactcaaattattttcatggtttatttgactacatgtgtgattattactttgcaggttgattttagaacctaacatcagccttagaggcagtagcaagccttgaacaagtgtttctccagtagtggtaccttgcagtttttcttttatttaatgctaagacatacctggctgtatacttacatatttcttaatattcattatagaatacagagtttttattcttccttggaacagaggaaatgtaagacttcatttatggctgaggctgttactaattgatcccagccaattctaaaataggctggtgtaaggattttcagcctcatttatgatttaagtacatactaataagccaatagcattcttaataaccattttctttggttattcaattcaggctatgttttgtgaatccctctcacatacacagagagacacacagacacacacacacataccactgttacataacacagtgggtatttctcttctcaaattatacagggttttctcatactgactcttattgttctggccaagtagacttagtgtttgaaataccatctttggatacctgaagcctgaggtaattgattcttgtggccttgctttttaaatttatcatttgatattttgaattgcagataaatttagataactgaaaggaataacctcagcagaatgtaggcgtctccattttgttcttattaaattatcaaagaatgaaatgtaaaatgaattatttaaaatgattgtccttgggggcctttggtactgagtcatttaaatggactggtaagaaggtggccaggcgcagtggctcatgcctgtaatcctggcactttgggaggccaaggcaggcagattgtctgagctcaggaggttgagaccagcctgggcaacatggcgaaaccccatctctactaaaaaaaaaaaatacgaaagattagcaaagtgtgctggtgcttgcctgtagtcccagcaagctacgcaggaggctgaggcattagaatcgcttgaacctgggaggtagaggttgcagtgagccaagatcacaccactgcactccagcctgggcgacagagcgagactctgtctcagaacaaaaaaaaggtggcccattttgtttgttgatgaccttcatgagaatggctagcacagaccgaggaaattattttctgctcaaacctaacctgatttctttttctttctgcatttttgccacctgattttattgtatgggaaagtatgaaaaccagttcctctcaataaaattatttaaaaattattttaaaaacccaacctcctacaatttctgaagtgcctgataatttcttccaatgaagttttcagtttactgattttttttttcactcataagaagggactgtggagtgaagattgtaaggcagtgtggtttaactgttttaagttctgtttctcttaaatttattctattcatgttatttacagagcaacagaagaaagcttagagaattaaagacaaattcaactggagaagcttatgagtagtagctagattaatttgaaaatgatcagtaaataactattttatttactgatttattttaaacttccaccgaccttattgaaatatacttccagaaacattctgtttgaactattatcataaattagtcatcttgcaaaacagctgtggcaatatgatacaatgaagagagcagtgatttagcaatgagaaggttgggagttcttgtcttggctccttcacagggagatcacatgacatgccaaagtcccctatatgaggaagccatgcattgagaggattgaggattgggtcaatgatctatcatagaatgctttctatgagtctagaagcctcatgaagaacacaccaggaaacttgggtgagagcaggagcttcacctcatgcagaattgcagtgtgattttagagtgctgttaccattcttatgcttagaagtcagagtgtctgaatcaggattctgttgtgtataatggattgcactctcgttggcttaggcagaaaggtgttaaatggtttgcagaattgttgggaaggctgagcttccaggagcagctcccaaagtctccacacacaactggaccaccagggaacctgctccctccaccaggacaggagccttaacttcagaaagctgcccacccagttggaaagctgccaccacagttgccagcaccatagcatcttgtctctgctacagtctctgtctacatagtgaatgcccggtgccctgcctctcttcctctgattcaggtcccactccaggtcttgcccaagtctttctgattggtggaacttaaatcacacccaaaatcccagctgtaggagagctgtgagatttcatctttccaaactctgtgtactgcatgggggttggagcacatgtcggcagccggtccactgcattcaccattgacagtaggtgaaatatttatggtcaataacatttgcattttttcacaaaaaatgcacaatttgcagagtagccatacacactttttatttagagctaatatcaagtcactctacatataaaaataattatttctgaccatttcccaagaaaacagctcttctaaaaattgagagcaatgcctacattatttcctaaagatgcaaactggtagagaaaacaggatgttaaattcagaatttcccttccagcttcatttattttctccacatcagttctgttttcctctgtgtctttttctcccatggggatgtcctccatcttttcaatctgatttgctctttgccatgcagacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtatttaatcattttttctataagcaaagctccaaattcaaactttggcccgacatttgatatgtctactatctctactccaccctggccctgtgttgttacaaccacaagggcgctttccaggtcctaccacgtgcagccactgcatgcaggagcctggctgaggctccagggaggcactgatggagagcctggctcatgaataacacaaatgcagcctcttcctctctaccgcttccttccatccagttcctgccttgctacctttcttttctgcctctcatagccattaaattcaggtcactactatttgcctttttgtcatctcatgagaattatgagggtcagctggagacttcatctcctaggaaacgagacatcacatctctgcacctggccctcttggaggcacccctggccatccccatcttgcaacctgctagacgtttttctacctggtcttgtacgtgagcacctgtgctaatctgtcactcctgatctaggtgtgttcccagcttttcctggtgttgtctgatggtctcacaattcccctttagtcatgcttatcttcctatatgagaaagatgcgtagctatacttcatacatatactgtacacataaacatagcaaatagaagaaacagaatgtgcatctgtctacagtaacaatatctttcttccccagagtgcaacaaacatgccattgtattgggagactgtagtaaaagttaatcctaggatgtacctggttgtctctgctaaaattgtttgcacctaaattagattaagactagactctacatattcaaagacatgaaagcctttcatgtctgtgaagacaggaaatgaattaacaatttgtacaagaacttttctgttccttccttctctaggcatctcattatttatacagtttctttttgctcagctatccttcatctaagactgacctccactcagctaaatcttcccttcttgtttccccaaagcagctctagtccggagaagaaaaggataatagagtaaatattacactaaacacggatactccttaagccaccaaaaaaagtaacaagaaatcaggaacaagtatatgctattttgaagtggaacaacatataaatgttcccatgttttttcttggcaggtggagctggacagaatatttctgtccataagacccccagaagtcccctaagtgggataccagtgaggactgctccagcagctgctgtctctccaatgcaggtagatgagccccagaaataaccactgcttatggtttgctgtgtatccctctagatgtttttctttacacatattagtgtccgtgtgtgtatgtgtgtgtgtagagtatgtgttttgtaaattggattgcactatgcattattccaatacttatttcactttatcatcggaatgtaagcttcatgaggtcagatatttttgttcattttgcttgctgttttatctcttgtctgtaacactggttggcacatggtcacattatagtagaagttcaataaatattaaatgaatgaaggaatatgttttcaaattttaatatttgcagaaacgattctttttataaaagattacataatatgtggtgatttatttagccactgttctactgatagaagttaggtttttttggatttaacttattacaaaaaataatacagtgaagatactgatacaaatttttgaccacttaaggggctactttttaaataagggtatatcaagattcatttgtaagtatcagagatgactgtagttaagcagaaaggaatttaatacagggattttggtactgagggctggagaaaggtctaggctgcactgagcttccaggaaaggttcccagagcatctgaaagttggcccattaaaggagcttctgtttctgccagaatcgggaagtctttctctaagtgcttacccaggactgccactgctaccaagatctaggatcagcctggtgactacactgccacaggtgcagtccatgccagaaaagcacactctgtgcctgccccatactgaccagaaaacggtggaacagaccccagaacctctgctcccctgccacagaacagcgaatgccttcccagccatgtttaccaggagaagctgcagaagggaagccttacactcccttgcaccttccagatcctctgagaaggggcctgtttgacagaagctaggccacttgatgagccaagctttaaaggagtttgccaagtacaccctttagcttcccagtcccttatagttcaataagtcgccctacaaggagatgaggatggagttgagtgagcccgtcttgagatcttctacaaattgattcctagtgaaggaaaatggagtcctagaaaaggaaatgtatttgacctgttccagcatgtcgaaaaacttgatagacacattgcccttcagtttgccctcccgcttacagtactattttccaagaattttgacactgtctataatttttgaagatcaagtaagtgaacaataatatcttgttttactttatcagtaaggtggagcacttcttcgtatgattataggccatttatctcttgtgtgtcggtgtggaaacttacatactttgcctgcttttcttttgaagtgttagtctgtttatgttttgtaagaagtattgatatattgtgctttttaacattttttcatatgtaattgtattaccttttttatcttttaatgtcatattaatagttatcttttactgaagagaaattttacatgtttgtgttgtgttttaagattttgttttgtttcctgccttaaaatgtcttttctagctattagatgattaaaatattctccctaaatatcttaaggaagtcttttatttcttcagtcttaaaacccatagaaacatgggtttggatttagatattcttcccctatcttaactgccttctggaagcagaagtaaatactctctggaggacaattacaccatctagatccttaaattatagccacattttaaaaaatacaacgttatatagtaactttaaacaataccaggcatggccaggtgcagtggctcatgcctgtaatcctagcattttgggaggccgaagcaggcagatcacgaggtcaggagttcgagaccagggtggccgacatagtgaaaccccgtctctactaaaaatacaaaaatcaactgggcatggtggtgtgtgcctgttgtcccagccactcaggaggctgaggcaggagaatcacttgaactcaggaggcagaggttgtggtaagctgagatcgcgccactgcattccagcctgggcaacagagcaagactccatcttaaaataaaataaaataaaacaaaaaaccaggcatacaaatagataataccaaatgatgaaaagccaagagaaaaaatagacaatagaaacagacacggaagattcagatattgatattattagacatagaccctaaaacaactgagattaatgctgtcaacaaaataagtgacaaggtagagaatttcagcagaaaaccacaatgtataaaaaagaatctgttagagattttatgacttaaaaataaaatacctgaattaaagactcaataaagtttagctgtagcttaaacagtttaagagaggcttaaagaactgaagacaagtcagtataaatatctgaactgaagcacagagaaaaaggataggaaatagagaaaaggacataagaaacatatgggatggaataaaaaaatctcatgtgtaattggagtccccaaaaggggagaaaaagagcagaagtgatattggaagggataatgatcaagaatttccaaaactgataaaagatgtcaagcccagattcaagaaacaataagaaccccaagtgagataagtacaaagaaaaccacccagacacatgaggttaaaactgctggaaatgaaagagaaagcatcctaaaagcacccaaaagaaaaaagatacctcaatgtccaaggaggaagagcaaaactgacatctttcttctcaagaagaatgatggaagccctgaagacaatgcagtggcatctgcaaaatgctgaaagaaaacacctgctttcctttacctcatgaaaatatgcttcaaagtgctgtacctggtgaaaatacccttcaaaggtgaacacaaaagaaagatgctttgagtccaacaaaaccagatgttttttcctaggatacttgcagtgaaaagactatttaaaggagttctgcatggagtttgttcttttaaaagactattaaaattcaaaacatctgacaagaaaagctaatgcaaaattacctgtatcaggaatttgtaaatgggtacatcactaaagatttcataattattaaagcaatagtaagagaatattatatattactactttgtgctataaattagaaaatattgatgaaatggtcaaaatcttagaaaaatgtaacgtgctaaacttacataggagagagtagtagaaaatctcaatcacctataatttatatcttttccttaaaagaaatgccagggccttatggcttcaccatgaaacctcccaaacatttaaggaagaaataatgtcaatcttacgtaaattcagagactaggaaagaggtcagcatagctttgatccctaatagttgcaagaacattaatagacaagaaaattaaaaggtctttctcacgaacctctttgcaaaaatcctgaacaaaatcttggaaaaccttattcagagacacatgaaaaagatcatgtcatgttgggtttattccaggaatggaaggtggttaatattgaagccaaccagagtaattcaccacattaacaaaggtataaaaagaatatggttggccaggtacaatggcttatgcctgtaatcccagcactttgggaggccaaggtaggtggatcactggaggccaggagttcaagaccactctggtcaccatggcgaaaccccatctctactaaaaatacaaaaattagctgggcgtggtggtgcacgcctgtaacccccagctacttgggaggctgaggcacaagaatggcttaaatccaggaggcggaggttgcagtcacctgagatcattgccattccactcctgggcgacagagtaagactctatctcaaaaaaaaaaaaaaaaagcatatggtcatcttagtaggtggtggcaggaaaatgtagtcgataaagattaatatctttcttgatggaaattcttagaaaagtaggaatagaagggaaagtctttaatctgataaagggtctgtattatatatctacagcaaacatcatacttaatggtgaaatatcggatgctttcccacaggattgtgaatgggataggaatgccccatattgtcacttttgttcagccaacttcaaaagcaagatttaaaactacttttgaaaactgtataccacgaccattatatttttgtgggatgtggatacatggaattgtgtttaatatgctatgaagtagagcctctaagagaaaataatgttctggaaagcctcagaatggccctgcacaggcaaatgtaccaggttgttcattgcagcattgttcctaatatcaatatcaacatgaatatcaatagagaatcagtaaaataaattatggtaatgaaaatagctaagatctactgaatgcttactatctgctgggctgtgttttgattgttctaactggatttaactcatttaatcctcccataaccctttgaggtaagtacgtttagtatcgttgccattttataaataaagaaaataaggcacagaaaattaagtaacccagagtctcacaggtgggtggtgccatctgtccccagagccacttacttggcctcttgtggcacttctcagaggaagctgccaagatggtgggtgatggtgggtatagaatgacttctaagatacagtaagtgaaagaagcaaaatggtgtacaaaacaatataatgctatgataacagttgtgtttttagaaaaacagagggtgtttttcaaggtttttccttgaataatatcatgcttacttgcattctgaaatgcttttttaaatggcagtaaaaaaaatacaccatgaaatctactctattaacaaatttttaagtattgttaactagaagcacaatattgtatggcaggtctctagaaaaatttttttttaaatttttaattttatttcagattcagggtgtacatgtacagatttgttacatggatatattgtgggatgctgaggtttggggtatgattgatcccatcacccaagtagtgagcatagtacccaacaggttttcagtgcttgcctccccctcctctagcactccccagtgtctcttgttgccatctttctgtcctctagaactttgttatcttgcctgactgaaactctgtatccacggaacaattccccacttcccctccctgaggcctctgggagccaccactccactgtctgcttctgtgattttgactactttagattcctcacgtacatagagttatgccgctcttgtccttcagtgactggtgtatttgacttagcataatgtctccaaaactcatttatgttgtagcatgggacaggatttccttcttttttaaggctgaataatattccattgtatattctataccacattttcttcgtccattcatctggtggtggacactggggttgcttccacgtcttggctgttgtgaattatgctgcaatgagcaagagagtgcaagtatctctttgagatcctgttttcaattttcttggataaatacctagaagtggtgttgctggatcatttggtagtactatttctaattttttgaggaacctccatactgttctgcgtaatggctgcaccattgtacattcccactaacagtacacaggagtttcattttctctacctcctcaccaatacttgttctttttcagttttttttttttgatgatggtcttcctaataaatgtgaggtggcgtgtcactgtggttttggtttgcatttccctgatgattagtgatgttgagcatcttttcatatacctattaaccattaaaaatagaatacttatacacacatccttgaatatacatagaacattccaggaaagatattcacaaagccaattaataatgattgcccttggagagaagaactgggagatgggaaggaaaaggagactttctcttcattatttgcccttttcattgcttttggggatagtgtctattgcatgtattacctattcaaataaatgagttaattaaaaactcccctggttattccactgtgtttaagaactgttgcacacacacgcatgcacacacacacatctgtgtttgtgctattcttgatgttatgagctcaccgtgctggtgtccccctggtttttacagaggcattcgacttacagcagtgtgcggccagccagcagaggggtgactcaacgcttggaccttcctgaccttcccctctcaggtaaattatgtcaacataaagaacttttgacttatctttccgtgcagttaacttttcttcatttctctgcatgaaactgagcttagaaaaataatcagtggcatttcttgcaagtgatttcaaccccgaataatgtacatatcatgaatgttagatgcagcagtgcagctgacaaaaggaaaaagtgtctcctgccagctgcacttctcagtgcccttgtgctggggagacaggcccaattttttttttcttttccttttttcagagacatggtcttgctttgtttcccaggctggtctcaaactcctggtctcaagtgatcctcctgcctcggcctcccacagtgctgggattataggtgtgagccactgtgcctggcatattgttttttaactgaacctcaagagcatattttctaatctttaaaaagtaactaagggaaaaaatcttacctgattttgaatttgtctgctacttctgcaattcttaaaatttgcccctttaaaggtatttgtcttttggtgcagtcctcttcctgttgttacaccgtgtgtgtgtgtgtgtgtgtgtgtgtgtgtgtgtgtgtgtgtatttgttttttgttttaactccaatcctggttgtaaagtggaggttgcattcagcagtcccagcagtccccatccatcacatttgcgtggcgtcatatttcctgtgtcacaggctgatgtgaagcagccctcaagaagggacacgtgggcttgagtctcagtactgctgctcagcctggctttggccccatcaccccacttctctgtgctttagtctcctcatctctaaaacggaaataatccggtccacttcctaggattgtatcaaggattgagttagcacattaaagcgccttgaacatgctgggtgtgtggcaagcactgtggaagtgtttactgtgcacatctcacctgctgttctctgctgacccagttcgcctgcccagaactaaagggacaacagtgctcaagcctagtgggaagttaaggttgtccagaatacggggcttagaacctatgtatgtgtctatgtggtgactgttaggaaataaaaaaggcaaaaagaacactgaatggactgtttactggtccctgtagaagggatagaaagccaaaagtctgggtcacatggacagaaatccttttgtttctaagcataaaataaaatttctacagctgtacttcctttagatcttggtcaaacacaatcaggcttgttcttaaaatagttgtttctatgagggaactttcccctctgaatcttctttgctttttcatggaattaaataaggattttagagttgggtaaacactgacaattgagaatttgaagatgatctgagcccattcctcgagttttacatgggagagattcaagccctacagaaattgagtgacttataaaggctacagcgattttggatggctgtggggccaggaagtctcctgattctttctaccatgtgcctcttggtgctgaggctggtgattgctcgagtaatagctttctaaagtggtgaaagtttacgtgggactccaagtcatgatagtgacttcccagcagaaggaaatgaagaccaaaggccagtgtaaagtcaagagtgtaagaacaaacagagttcagtggaggtagagaaatgagagagtacgtgctccaggagaccaggcctgagtgtcccatactaggaggggagtggaggagaccagagcacagcaggaagcccacttggctcaccatctccgtgcttgctgtgtagcacaaaagagggaataatttgatgacacgcatagtgctaggtgtggggtttttgaaaaattgtggtaaaagacacataatataaaatttaccttatcaaccatttttaagtgaactaggtaagcctttggtagataatatttgttcttctctctgttccactagccttaaagttttctattgtgtagagacaccattctttctggttttctttgagagagagtcttgctgtcacacaggcaggagtgcagtggcattatcatagctcactacagcctcaaacatctggcctcaaatgatcctcctgcttcagccttcaagtggctgggactagaggtgcatgtcaccatgcctggctaattacaaaaattttgtggggggatagagacagggtctcactaagttgcccaggctggtcttgaactcctggcctcaagcaatcctcttgccttggcctcccaaagcgctgggattacagttatgagccatcatgcctggccaagaaaccattcttttttttttttgagatgcagtcttgctctgtcacccaggctggagtgcagtggcgtgagctcggctcactgcaatctctgcctcccaggttcacaccattctcctgcctcagcctcccgagtagctgggactacaggcgcctgccaccatgcccggctaattttttgtatttttagtagagatggggtttcaccgtgttagccaggatggtctcgatctcctgacctcgtaatccacccacctcggcctcccaaagtgctgggattacaggcatgagccactgcacccggccaaaaccattcttttagttgacacggtacatactgaacttgagaccacaatagcttattgctctgcagttaatatctcattgacagccctccctacttagcccccaccaggcacctgtctgcttggatgattatatttactgttattacagcaaaggattacagtgacaattacttgcttctagcaatccccaggaattgcttgtcaacactgaggtcattggaagctgcagaaaccaaagattaatgtgctgttcttgttgttcccttggatgtaaatactgtttttctctgctatttagagctgactagcctcactcccaactttactgcccctaattggtggcagtgagctgtggaaggattactttcttctgtgactattcacaggtcatgggcggcaactgtgggctcatcctggtccctggtctgctctgtagcttagaacaaggcacttagttctctgagctccagtttcctctataaatataaactagacagtctcgaaagatgtctcctgttccgcacttttatggtcctttgagaaatatagtctggctagacatggtggtgcactttcctgtagtcccagctacttgggaggctgagacagaggatcattaggaggtcaagtccaaatccagcctgggcaacacggcaagaccctgtctctagaagagaaaaagaaaaacaagtatcatctggaggattcagttcatttcattacctgttttttgactcagactaatatgacagcagaaaggagccttgaaagagtgattcctacttcttgtttagcaagccaggccctatggctagaatggccttttctcttgtcaagtagttcttcttggttcccagcttcttgtttattgctgcctgtggtctgatcatcacttgaggcattttcctgccactctctctcagatgtctgtcagttaaaacaaaagatactacctggggacagggctggcttcgttggcacttgcacaaggcccttagaaggacacatgcttggtgtaatgctctgatgacatcatcttgaaattcacagtgatttttgagcaggaggttgatttggtgctagatgctgtaaatgatgtagtggtcctgcctgtagaatccacatccctattgcatttttattacttcagaaactatatatatgtttgcacttgaggataaaatgagaactgtattgtatttgagaatgaagtatgatggcagtcaagagctgcttctttgggaatgagtgattatgtggttgttcccacagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcaggtatcgtgtttcaaacaataagaaatcagaaaaacatcgggctaatcaccttttattcttccttccgttttgtccccgtggccaatttacttctacaaatatttcctgcatgaaaatgactaagacactgtgcctgcccttggtgagtctaaaaggatgacagtggatagtagtagtgcgcaaaatggaattaagggctgtaaaaaacaatactgcataagcaaagtcttgagaggttgttagttggatcaagaagtctagagagaagtggtgtttctgccaagggctctaaaggtaccattacaagcacgctgtggaatagtgatcagggaatgtgggtggtgtcatgtgtctgaactagtctgtgggcttcctgagagccgggactctgctgtacatatgcataacaagctctctgtcagtatttgttgggtggatggataagtgactaggacattccatctggagggcatattgtaagtagtcttcattgctaaggaagaggtttgtgcattattttggtaaagcactggagtaccaccaagtttgtgggattttgtttcggattttgaggttgtacagtgagattggacctgcattttaaggaggattcatcagaaaacagtggtatataaggattgaagaggcattttgaaatcagtgtttaagaaggactgtcacagggatgtaaaggaatggttggcagagggagaggatggcaagaccagcagggtggtcactaagagcttgtctttgttcccacacctctgtcacctcctccctttccagtgcccctggtcgcccaggccacagcaaacctctttcagctgcttcctctccccttgtgacttccctgcttctctgtgttggttaattttctgatgcactgagcacatcctgctgcagaccttgcagaaatctcacatgactctgtcatctgcactcctcatcctggtcttctagatgccccacaacttagcaccaccccacccacctgccagaatggccctgttcctccctccacctgagcctgttttagtttctgcctttgtaatagaacatgaccatgtctgattgcaagtctttatgtataaggttctagcctgaatcgtttttcttttctcctttcatactccaaatactgcttctccttcaaggtcaaacctttcatgaagttgtacctaacacctggcacattgacatatcccttctctgactttggcgtcttacacttttttgggtgtttagtttttgtactgctttgtagtgtggaacactgttgcacagtacatgccattgtctccatttatgctataatttagttgacagtaaaagttcaacttacattttggtatctcttccagccccttgcattgtgcaacacacatagcatttcacttagtaaaacttacgagtgagtagatggattaatatacaaaattggctagtttaggagtaatagctttttaataaatcttataatcacaaatatgggtattatagaaggatttataaaagtctgaataaattcaggtcttgttacacctttgggtacagcatatatttggacccaaatagatgaagtcatgtgtttcagaagtttaatgtaaagccccagatactacatattgtcctgtttatgtgcaagagatttaaataatcaaaagaggttttaaggaccagaattagtgctgttctgaagttgccgttttctttatgccagaaatgcatacaaaaaggctatatgtatatgaatatgctattgatattttaccttttttaatgaaaagttaaattagtaaaattcttatttcaattttacacttacgttattgacataaacaatggcaagatatttggtgtttttaatatgcccttccaatgcacctttaaaatttattttattttattttttggagatggggtcttgctctgttgcccgggctgtagtgaagtggcacagtcatagtgcactacaaccctgaactcctggcctcaagcagtcctcccttctcagcctcctgagtagctgggattagagatgcacaccaccatgcccagctaatttttttattttttatttttttaaagatggggtctcgctatgttgcccaggctggtcttgaactcttgggctcaagagatcttcttcccttggctcgtaaagttctgggattatagatgtgggccactgcacccagccaatctaccttttacatgttatttaggtactggtttagtcttgaaacatgtagggtgtgttttgtttacgtatctttaattcaaatgatactgtacttaagtaaacaaatgaaagactagatggatgagcaacaaatggatttgaaaacaaaatgtaacaaaactctccccaaatttatgatagtcaggaagcacaatttaatttttattttatactgtgagatatcacaaaatagtaatgtgactaattcggctgtttctttagaatcttgctggataaactagacttttgcttttctaaagtaggtatttatttcttgtgtatttgagaattctaagtattagcatcttctccttaccatgtgctcttctttctaaccagtgtggaaagaaaagaccctctggcagccttggcccgggaatacggtggttccaagcgcaatgctctactgaaatggtgccagaagaagacacaaggttatgcggtaagggacaacatcagccaacttccagctgcccctgggcagtagtagtcctgtgccaatacatgttccttgtgtgcctgtgcttgatgggccaatatgcatgtaattgtcatctttctattctcctaggcagggctgccagggaatgtttgatatttgtgcactgcccaaaggcaccgtgacagaggcaaatgcaactgaaaaacggtctgcactccacccaccaaatgtatggctgcacgcagagctgcacctcccgagggaaggggacctttttctttggtcagagtgttactggccacaggttcttgggctgtcaatgcgatagaaattgtcatgaggccaaaagagttttctcaacaaggctttattggagcttatgcccttatccctcaggcatgagggaggaagcacgggagagggaggattctctggctgactccttgaaatgagctggtagggatttttttattaagcaaagtgcaggaattgatatcaacatagagaatgtgggctgggctgggtagatcatatgaggggtaggggatgtgggtcagtttatctgctggcgacggttgtcttgagtcatgggccacctagtgttctggttggtggcagcaaggctgtaaatcagttgtttagcattcttccctgagatgaggacatttgcaactttggttggatatgttggatttcctagggccagtttctggaattatttaagtaaaagaattaaacattcttttattcttttaaacattatgagagtgcggaaaaacagtatggctattttctttgcatgactgttaagcaggtatgtcagtgaagtagtggtgtgggttttgtgatcagtgggaatgcatgaaagaatgctatagtggggatgagctgaagccaagtcctgtccctgctgtctcagaagaagacacaagctccagtggctcacgcctgtaatcctagcactttgggaggccgaggtgggcagatcacgaggtcaggagatcgagaccatcctggctaacacagtgaaaccccatctctactaaaaatacaaaaaattagccgggcgtggtggcgggcgcctgtagtcacagctactcgggaggctgaggcaggagaatggtgtgaacccgggaggcgaagcttgcagtgagccaagattgcgccactgcactccaggctgggcgacagagcaagactccgtctcaaaaaaaaaaaaaaaaaaaaagcagacacaagctccccgagcagtgatgcctccacccaagaagacagcttttgctgaattaccctcctgaagaagagtgctttgcctaattcgcataaaggtcctatgtagttgggcctccaaaacttctccaaacattttgtttctattgttttgagaattgtttgcgtttagtttaagagtttttgttttctaggacagtatctgttttctgtgaatatcagaaaagggaagtaatacctgatgtaagtttaagtttttttcttgtgaaatacacaaagataaaatgcacaaaatataaatcataatttcttgaactgtgaggaagtgaaaagtcatgcagtcaccactcccatccagaagaggagcatcaccagctcccacagacccttcctatgactttcccatcatagccctcagtactccctaagataaccattgtcctcaattctccttccagatttttacaaaagtatgcatccgtaagtactatgttagtattgcttgcatttgaattttattacaaatggaataaaaaactatgtaatatttgcagctagctttttttacacggtattgagtcagtgagatttatcctcattgttgcatatagctgtaatttgttcattttcttcaccatttagtaacccattgtaggattataccattatttatccattcgattattgatggagagttgagtcatttctagtttggagctattatgaataacgctgttatgttcttgtgcgtatttcctgaaaaacatatgtgctcattcctgctggatacatgcttaagaatggaattcctgggccatagggtatgcatacaatctagtggatagtgccaaacagatgactgaagtaattgtataatttatgtctctccagcaatttatgagagatttatttctctgcattcacatcaacacttggtattgtcagtctttttactcaaggtcatgtgggtaatgtgtagtactgtctcactgtggttttggtttgcattttcctgttggctggggaggctgaacaccttttcatatgcaaatagataccctctttaaaattggcaattcctactgcattcttaacaatattttgctaaaatttcggaagattccagcaccgtaatactcccttcccaggctgaagcttttgagggaggtggggatggaaaatgaaagaagctagcaagaaaaacccagcctcagccaagatccatcccagatagtaaattagcagggctgggagtctctgtcatgtcagcagtcagatgtcttaaaaccagaatctacccagagtatgtgtatcctgtatctttgccattaccttcttttcactttatgttaaaaaagaaaaagaatcgcagcactttgagaggccgagggggcaggattgtttgcgcccaggagtttgaggctgcagtgagctgagatagcaccactgtagtgcagtgtgggtcagaaaaaagaaaagaaaaacctgtcatgctactgaccaataatagaggctcccaaagtataaactcgcctcagacccttgtttattcttcctgctaccctgtccactctgcctctgccctgtttcaaggatggaccatgccatgaaggaaggcctcttggttacagcctcccccagcccatcagccacgctgccgaggacacgggaaagaataagaagccataagaaccaatagctatgacttcttattctttcctgtgtccttggcagcgtgactgatgggctggggaggctgtaaccaaggggccttccttcatggcagttgaacaatgtgaacacttggacacaggaaggggaacatcacacacgggggcctgttgtggggtggggggaggggggaaggatagcattaggagatatacctaatgtaaatgatgagttaatgggtgcagcacaccaacatggcacatatatacatatgtaacaaacctgcacattgtgcagatgtaccatagaacttaaagtataataaaaatatattaaaagaaaataaataaatatcaagaaggagaaagaaaaaaaaagaataagaagtcagagggaggcagctgcctgcaggaggtttagcgtaaagaaaataggaatggtgatgggaaattgaagaaaacatttaaaaagagctgtcattcaagaatgactccactgatgccgcctgtgctgttccccacctgacagtaatggaccaaggcagctgccagagtgcatatgaaaagacaattcacgttttcagaaggagtggccttctatgatgtaaccttgttgtaatgcagggaagagacagacaataagatgtttccagtcaggatcacaagaacactatttcctgctggagtgatttgtgtgtgtgtgtgtgtgtgtgaacattttggattcgttttcaaaacattttacgtttgatgaaacccaaaactcattttgcctgtagtacttttcattcatcatgaaatctctgtaaaattagaaatatgaccatgtgtctgctttatttacccttcacaaaatatgtctagacctgtttgtctgagacacctcatagtcttgttctctcagaattaggaagccaaaaataactggtgaaaactttttgaaaaccgggaaccatgtgtacttgacttaaaataactttccttttatttcatcaaaatacagcgtgaaaggttatgttacatccctccatatatatatatttttatttcagctttagttatagattcagggggtgagtgggcaggtttgttacaagggtatattgcttgatgctgaggcttgagttatgggtcccgtcacccaggtagtaagcatagtactctgtaggtaggttttcaactcaggccttcttcccttcctcccttgtctagtagtccccagtatctattgttgccatccatgtggctttttttggagacggattttttttttttttttttttttttttttttttgagacagagtctcactctgtcacccagtctggggtgcagtggcacaatctcaggtcactgcaacttccacctcccaggttctagcaattctcctgccttagcctcccaagtagctgggactacaggtgcaccccaccacacctggctaatttttgtatttttagtagagacagggtttcgccatgttggctaggctggtctcgaactcctgacctcaggtgatccgcccaccttgacctcccaaagtgctgggattacaggttcacacctgtaatatacataaagggctactggatacatatacataaaaagggccactgcacctggccctttatatccatatgtactcaacgtttagctcccacttataagtgagatgtggtatttggttttctgttcctgcgttagtttgcttagaatagtggcctccagctgcatccatgtttttgttcttttatatggacatgatttttgttcttttttatggctgtgtatttccatggtgtatatttaccacattttctttatccaacccactgttggtgggtacttaggttgattttatgttttttctactgtgaacagtgctgcaatgaacatacgagtggtagaacgacttatttttctttgggtatatacctagtcatgggattgctgggtcaaatgttctatttttagtaccttgagaaatctccaaactgctttccacaggggctgaactaattttattcccaccagcagtgtataagcatttctttttctccatggcctcgctagcgtctgctattttttggctttttaataatagcctcctggctagtgttagatggtatctcattgtggttttgattcgtatttctttgaagattagggatgttgagcgtgttttcatgtttattgaatgtatatatgtcttcttttgagaggtgactgttcatttcctttgcctattttttaatggggttatttggtttttgcttgtggatttaagttcttatagattctggatattagatgcatagtttgtgaatatttcttcccattctatgggttgtctgttaactctgttgatagcttcttttgctgtgaaggaactctttagtttagttagattccacttgtcaattttttattttgctgcacttgcttttggggacttagccaaaaattctttgctaaggccaatgttgaaaaagttatttcctaggttttcttctaggatttttatagttcgaagtcttatatttaaatctgtaatccattttaagttaatttttatatgtagtgacaggtagaggtctagtttctatcttctgcgtatggtcagccagtcatcccagcagcatttgctgaatagggaattctcttcccattgcttgtttttgtcaaagatcagatgattataggtttgcagctctatttctggatactctaacttgtgtatgtgtctgtttttataccagtgccatgctgttttggttactgtagccttagaatataacatgaactcaggcaatgcgagtctccagctttgatcttcttacttaagattgctttggctattcagactctgttttggttccatatgaattttagaatagttttttctaattctttgaaaaatgacatttgtagtttgataggaataccattgaatctgtaaagtgctttgggcagtatagccatttgaatgatactgatttttccaatccatgagcatggaatgtttctccatttatttgtgtcatagctggtttctttcagcctccttccatatattgttcagctccaggtaatattgtaggtgctgggggccgggcgcggtgactcacgcctgtaatcccagcactttgggaggctgaggcgggtggatcacaaggtcgggagatcgacaccatcctggctaacatggtgaaaccccgtctctactaaaaaatacaaaaaattagccgggcgtggtggcacgcacctgtggtcccagctgctcgggaggctgaggtaggggaatggcgtgaacccgggaggcggagcttgcggtgagccgagatagcgccactgcactccagcctgggcgacagagcaagactccgtctcaaaaaatatatatatatattgtaggtcctggggattccacagtgaatgaaacaggcaacagtccctgctctcatggaacttaaatcctcatggggtctggcagttaactgaaataaaaggtaacatatgtacggtatttgaaggttgtattgccgtggagagaaataaagcagggaaggagggttgggaatgttgggtgaatggtacaatttatacatagtggtcagggagatgacatttgagcacttgctcccctctcttgaagggctttggtgtctgcatgaagctttatttcccaccaaggcctaggtgtggagggtcagagtaaggaggtcattactgtcgttactgtgccaatagaagctgaagtgacacacggtggtcgacccaggtcagcagcactgggaagtgagcatcgcagccagacccacctgccgagctccgggccaactgcctgacatctcgagtggcccaggattgagacccagtgaaaggatgtgagtttgccctcactacgaagtgaggcccagttcactaagctcaaaatggcgctcctaggaggcccttcctcacattctgctcaactcatacacactggtgtctttttggaataagtcactcctggaaaggccctctaaattactctcagtcctcaaatttcatactcctgatgtgtgttggctgttttccaagccaagggcaggcctgactcagataactcctacccctccctttctttcatctgaaagtctagtttaagctcctagttttctgttacgatggagagatttccatttgtaatttccagtaagaattctgaagggacagaaagtcgggagggtaggtgtgacaggaagaattctgaagataacccccatgactctccatggtagaatgtcctcctctttatatgacacagggagatggtctggatatgcccactaatcacaaacccctgtagaagccaagtgatgtctctggcttgtggcagaagttggggaaattcaaagcatgagaaggactctgattgttcttggtggtttgaagagggagggggcacgtgagaaggagccaagaagggccccctggctggcagccagcaggaaacagggactttctagcactaaagcattagtgctgaggtcctggccgtgcccagaaattgccatgtgggtgctctggagttttgaggttgacaactgcaagttgtgtgtagtgccaccgggtcctttgtctcctcctctgtcctgatgccctcagacctcagccaggccagggacgctcagtttgctttgccttctgctttccctcagctgggggatcttgggctggaagtcactctgatgaacatgtggaattcagctctaagtctctcctgagtcctctgttacctcccaggaggcatgatgaggcacagctacccttcacctccatgggtggcatgaagatacttgcaagtatcttttagacgaaaatatataccggtatttactgttacttgaattcctgtttggttcttgcatttcagatcaaaagaaagaagagtttagatagggatttacttgaaaatgtatctgtatctgttccacttttgaaattgtatggcaagaattcagatagcaggcgacacctacactatcattaagggacagatgacgtctttgaaccaggttttaacctgttagctcagacctatatcttcttctcttttggagaaaaaaaaatcagtctttgtgtgtccacactgaattttgctttgaatctggaaagaacacccatgttgcaggcaacttctgttgttctgtctctgagttcccacaaacaagcactaaaatctgcttagccaatagcaagcagcctctaaaatatcaggtcacttggggctctgtttcttatattcttttttgagacagatctcttgaaggctacacgcacaattcaaagaacataaagcctttgatttatttactgccatcagagtggtcctttccctgacttagatgatagagtctcaatagcagatgcgcggcactgtgggcttccactctattgaggccttttctacccactttctctgcttctgtaccgtttctgacacagtggtctgtgaagacattttcagtggcacaggtgttgtcctacaacctgtgacaacagtggagtttgtttgcaaaataaagatgcaaggctttcccatgttgtgggagacacagtcctctcctggtggccgtgtttctggttggttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggctcaccacaacctccgctcccgggttcaagattctcctgcctcagtctcccgagtagctgggattacaggcatgtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataaatctgtgaatagccgtggccatgactccatgctgcgtcctgtgggtccttcccctgatcattgaacacgggctttttattgagccttaaaaaggagtaaggcactgacacaggctgcagtatgaatgttccctgaagacgtgttgccaggtgaaagagctgggtgcaaaatctacatcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcaggaggactgctgagaccaggagttcaacaccagcctgggcaacatagcaaggccctgtctttaccaaaaaaaaaaaaaaaaaaaaaaaaaaaaaaaaaacattagccggctacgatggtgtacacctgtgattccagctattcaggaggctgaagacagagacttacttgagcccagaagttcaaggcctccgtgagctatgatcacaccactgcactccagcctgggcaacagagagagaccctgtctctggggaaaaaaaaaaaaagtgtgccatgatgatgaatatcacttaccatgcatttttatgcttatgctaaatagttgtgaaatagtgccaaatttttgtaaagtaagttcctagaagtgaatttgtttttgcaaaagggtgtgttacactttccattttaatatatattctcaaattgccttcattaaggttatttagtttacacttctctatacagtgtacaagattatacattcccaatactggatacacctactcttttgatctttttcagcctaagaggagaaaatggcatttcttttaatttttcattgcagatgaaggagaagcactttttatcaacttgttagttatttatatctttcttctgtgaattactactacagttgctttgcttgcttttctatttgtatgttcatcttttttcctcaaaatttgtgatagctctttttggttttcttttggtttttatttttatcaaagctctgcatgcccacaatcaggtatgcagagatcctgatgagcaaagcagtcagccggcctgagagctctgcttcctgctccccagagtcaagcattttcaagtcaccttgctgattttttttttgtcatttacctctacgttgctgactagcacgtttatcaactgctatttctagtttttcattttagatgttgtattttgatctcctactgtgaaagatgagggtttatttctttttcactcccaccccccccatgcttcctgtctttgcattctttcatggttgtacatatctggagttcacattaagatgctgtgagtgtcattcatagattagccatgtagtagtatacactgctgcagctttttcttttacacaacctgttacttgccttacacttaaaatcgtcttgtttttgtctgtttacttagttttgtatgtaaatgatactcattcaaccgcaactcttcatgagatatccccacacatcacaagggtcaggggttgcagctgtgttatcctgaggagatctctctggagcctctgacctcttccatcatggctgccctctatgcctggtgcacagagtccctgttagttctttgcctctctcttttttgatcttctgtatcctacatcctattcttttttttcccctttgtttttttttccctttgtttttttttcccttcagtatctccctgagaatgagttcatagatggtaaaattttatgacctcgcatctttgttttaccctgatgcttgatggtttctttaggtataagattttaggtcagaaattattttcattcataattttgtgggcatcgctccattgtcttctatttgccagtgttgcagcaagaaaagaatgattacagtcgtttgtgatttttttttcctctgcaaaagctcataggaggttctggttgtctccaggattctaaaatttcagggtgatgtgccttgctctatagcttaagttttgtgttttctatcatgctaggcactcactgcaccctttcaatatgtaattcatgactttattttctggaattatttcattggtaatttcttctactctgttttctttttctggaaatccccctggcctggccctctaattatcatattctttttttcccctatttctatctctttgcattacagttttgttttctgggaggcttccctaactttaatcttccaaattctattaaatgcttaattttgcatttttttttttgcttttgcatcatttcaattgttttttaattgtgaaatgtacataggataaaatttaccatcttaactatttttaaatgtacagttcagtatcgttgagtatgttctcattattgtgtaaccaatctctagaatgttttcattttgcaaaacttaaattctatacccattaaacactaatctgacattcccctcttcccccagcctctggcagcagccattctactttgtatcactatgaatttaaccactttaggtaccccatataaacggaatcatacagtatttgtccttttgtgtctggcatatttcacttagcatgatgtcctcaaggttcatccatgttatagcatgtgtcaaaatttccttcctttttaagactgaataaaattccgttgattatatttgctatcatatttttaacttctaggatttcttttttattccctgaaattttttatagcatcctgttcttgtttcacagatacaatgttacatatgaatttcactgaggattgtaggttgattttatcaccaaatctctctatgcagattgtttcctacagtccctttattccattggtatctttaggtctctatctttatgctggaggtttgactgctcatgtttaggtggaggctctgcaaagctgaccccctccctggcctgcgtatgaggcctgcgactatgttcctgtggcatatccatgacgaacttctggtgtcagtgtctttaggtggtccttcctcttgggcacatccattctccagagaaaggccttctagtctcctgctggaggacatcaacctggcaaccagaattgtgggacctaatcagaaaagaggcctgtgggccaggcacagtggctcacccctgtagtcccagcactttgggaggccgaggtgggtggattgcttgaggccaggagttcaagaccaggctggccaacatggtgaaacctcatctctactaaaaacattagtggggcatggtggtgcacgcctgtagtcccaactgcttgggaggctgaggcatgagagtctcttgaacctgggaggcggaggcgagatcgtgccactgcattccagcctgggtgacacagcgagactctgtcaaaaaaaaaaaaagaagaggcctgggggtggagagtgactacctcagccctcaccatgtaaattcacttaattcccttgttttcactgcatcactcatgcctccactgctcactgtcctctgggtgtgcacagaagagagaacgtttggagctttggctgctctataaacagatctccaacccattcttcctgtttttaaccaccttcattcccccacctgaagcacctcttgccaccaatttcctgtgtctttgagggattttgcaccataaatcaggttgggtctttgcccttcgccactgctggcctgggatttagtttgcttcggtctgttatgttagttatctcttgtccattgacttttcagctgccaatgttttgtctttttgctttctttcatgttccctttttccttgtctgttaatgcctttggaggaaaaattcctttctgtggttttctggggcttcacgagggggtgagattgtgaatgcatgcgtttcattgccatcagcctggaggcctcagagagctttattcctttctccttaaggatattaaccattatctgtcatagaggttccaagtaccctttacatatatactatattatatacaaatacacacacccttttgttccttctggagtgcatttgtgtttgttaggtcaagttttatttttcccccagatggatggctatttatttcagcatcacttatttcatcatctctcttgaactaactgataggcctaggtatgaatgggaactgagtggtgtctggacttgctgttcccttctgtgcctctgtgggtctggcctctgccacaggttgctgccgagcagagaaatgagagcaggacctgagtgcggcacagcgccctgggcctcagccagggtcctgtgagtgtcagtcagtgctgtggcatgcgttgttttgatgaatttaatgccctggcatttttcattatttgattatacttgttggttttctaggtaaactattacacataacaatagttttgtttcctttttttcttttttcttttttttttttttttttgagaggtagtctcaaaaaagtctcggctcactgcaatctccgcctcccaggttcaagtgattctcctgcctcagcctccctagtagctgggattacaagcacgtgccaccacacctggctaattttttgtgtttttagtagagacgaggtttcaccacattagccaggatggtcttgatctcctgaccttgtgatccacctgccttggcttcccaaagtgctaggattacacacatgagccactgtgcccagccttgtttcttctaatatttatacctcttgtactttttttggtttattgcattcatgaaagtccaggtcactgttgaataatgctattgatggtggatattcttgttttattttctgttcgtaataacagaaataagatttaataatattattaaataatttaataataatttaataatcacctaaatgagattcttgtattgttttgtgataaatactctatcaactaaaggaagcttgcatctgttttgagcttaccgggggatgttttaagtccagaaataggtaagaattatatcaaattcctttttagcttttaatgagctatccatatggtttcttctcttttgacccatttatgtaattaataacataaatacatttactagtaggggaacatttgtacatatctgggggcaaaattccaacttggtcatggtatactattcctgaaggaaactctacttgattgtggttattctttaatgtgaaatatacgattttttatactcagttattgatgagacatttggcttcttgttggttgctttggtataaatgaagttttgtctcaataaggcctgtttttgtttttgttatgatgttagtgagctctaaaaccctgtatcatctgtatatagtaaaaagtgcaataggtatttattttaccaccttctgtagtaggattaatgacagaattaattcttagccaaagagaatgttttatactctagttgcaaagttctgtccagtctgacaaatgaaaacctgaaaaccccaaaaatgttgttgggtagaagttgggaaacctttcatttaagcttcagacaatttttgtgaaaagtataagagtgaagacttaacatttttcctggaactgatgctcttttgttttgatgaaagtcctctgaaaggacttgttagttgcatagaggtaaggctaggcccctgcctattctcagggctcaaggcctgagcagccgaaggcccatcagtggtcccagttacctcagtgggagctcaagtgtcccctgtccccatgtggccacttgatctgctggattctgagtcaggtgtgttgaaatctcttactctgactgtggtttgtgtcaaaagctttgattgctgagagattatgttccagatattttgaaccatacgtaaaggtttcttgttctatcttcttggtggtttttaccttttacttcagttaatccttttgatctagaagcttacattttatataccaatattgctatttccatttatgttttctgtgcattttatgttttgcatttatgttatttgcatgatatatctttgtactttctttcctttcttctctttttttcccccagagttggagtcttgctctgttgcccaggctagagtgtagtggcacaatcatagctcactgcagcctccacctcctgggctcaagcaatcctcttttcttagcctcctaagtagctgggtctacaggtacatgacaccacacctggctaattctttaaaaaatttttttagagacagggtgttgctatgttgcccaggctgattttgaactcctgggctgaagagatcctcccacattagtctccccacttagctgggattacaagtgtggagccactttgcccagctcctttattttcagcctttcttagttggttgtttcagggttatgtcttataaatagtttggctttacatgtaatctgaaaattcctctaacagggcagcttagcctgttcacattttcttgtggctgtatgtgttttatcttcttcctctgtctcactttctatttttagtagacttctcttgctggcttccttcttactgattcccaggcacctagcagcgtggtaaggtgtgtgagttgaagaggtggaaaaacccaggcctgagactctgaggggtaaccacagtggaataatcataaagtttaaagctagagtctgtttttgttaaactggagcagaatcataaatcaaacacattttaaaaaatgcagagctacagagccggctgcattagtgagaaacagccccgtcggcccctttggggtcagaagtcagaattggaggcagggcctgggcccagttgctcttgccagggctgctttctggggtagaatggaggaagagccatgggcaagggccaagtccactggccactgtcaccaggggagcagcccgaagtcagggccgtacctgggaacaagaaggactccaaagacctggagcagatctggagcactgtgagttggaggagtcgggctcggatagcagcctgcaagggtgagggtgctgagaaagcaagatggacagagagggacagatgtggcccattcagggatccagaccagtgtctcatggcatctgatgtctagtcaccagcatgcatggggacatgcctggacacttgggctgatgcttctgcatgactgagcctcacggtagcagggtgcccctggacagaaacaaccacatgaccaagcagaactccttagcagccatttaaaaggataactggaaactctccaacctaattgggtaagatggcttaccaatttgctaagtagggcatatgcttaaagtactttttaaactttttttttaaaatgatgctgctaaatgaaagtatgtttaatttcacagggaggatctgtttttgccaaatgaagttcacttagctccttttattggtgctttggggaagagggggtgtggtctgtccctttagccttatagttcttgatctggtttttctttttttcttttttattgtaaaatacacataacatgaaatttatcattttaactattttaagtgtacagttcaggggcatgaagcacgttcacatggttgtgcaaccatcactgctttctatttccgaaatgttttcatcatcccaaactgagctctgtatgctttaaacacggggtaggggactccatattccccgccctcagcgcctaaccaccgttccgcttcgtctctgaatttacccattctagccaccttgtagacgtggacttacacagaatgtgccctttgatgaggggctgatttcactcagcacagcgtcctcaggcccacttatgttgtggcgtgtgtcagccacgctgcttctgcatccatctgtccaccttctcctctccatagtccccaccccatcctgggtcaggagttgtgatttttccttgtgtcttccagaaccaaagctgggagatcgcctgctaccatggcttgaaaacccttaacgactctgcagccagcagagttggacccatattcctggcctgtgtgaaagaccggctttttttaatgggactatttagctgtattatttgtcctcccttttctcagaggtatggaacatagctcccctccccaccctcaccacacctacctgaaaaacgggaagattagatccaccatgtccttaaggaaaagaagagagtgttttgattgccaacaatttgggctccaggcttctgtaagtcatcaaggtccatattggagaattagaagcaagagggtaacagaggcagaggataagagcagaggcttaggttgagggagagcagaggccagcgcccttggatgtggtggccgggggctgagaggtggaactgggaagactggaaactcagccaccctacaggctaagggcccacatcctccctcttctgacctgccaaattcctacaacatgcaggagaaagtgagggaactaataaggtgagcttattaatctggttaaaggttcttggctgggcacagtagctcacacctgtaatgtcaacactttggaaggttgatgcaggaagatcacttgagtatagaagtttgaggctgcagtgagctatgattgtgtcactgcattccagcctgggtgacagagtgagaccctgtctctctctctctctctctctttttttttttaaaggttcttaccatgagttagcctcgtcttctgacttcccagggtcatttgaaggaagcatctgcatcaaaactgccaatttacactttaaaattttttatataaatgttagatgttttgccagcttcaggaaggaaaaacaggattttcaaaataaaatgttataagaatgtgtcatcctcctggggactgagggtgatttaagtcccttggtcttctttcctcccatgggctgtttgtccccagctgagggcctccatgggtcaagtatgccagcagctgctgctgcagcataacactgcccaacaccaaagccatcatcttgtcaccattcagaaaaaggaggccttgatttttgctgctgttccttctccatcccccaggacagcatgtgagtctatttagataatcacagtcccaggtgaatctgcactgagcattttttccattctcttactcgtgaaatgttcatttgggaaaaagaagtaatttcatggcaagacacttatgatttcacaggctgaattcagtctttctgagggtagaaggttaacggagttgaaggttacttttctttctttttttttttttcttttttttttttttctgagatggagtttctcccttgttgcccaggctggagtgcaatggtgcgatctcagctcactgcaacctctgccccctgggttcaagcgattctcctgcctcagcctcccgagtagctgggattgcaggcatgcgccaccatgcccggctaattttgtatttttagtagagaaagggtttctccatgttggtcaggctgatcttgaactcccgacctcaggtgatccgcctgccttggcctcccaaagtgttgggattacaggtatgagccaccgcgcccagccttgaaggttacttttctagtataaactaaacttgatcttggaacaaaattccttataatcaatttttcagttattgcatattattttcttagtacaattctaattctgctgactacagagtcagaaagggtttaaaaaccatggtgacaggtggtctcccagccagagctgtggttttggaagacatgaggaagaccacaactcctgaactaggatgggggttgggatatggagaggagaaggtggacagatggatgcagaagcagagtggctgacacacgctgcaacacagatgggtctgaggatgcttcagtgagtgaaatcagcccatcaccaaagggcacgtgctgtgtggtggaggaacatagtcgcatgtgtgttgttgggaggtggagtttaaggtggaagaacctctttgagggcaatttggcagaatccatcaaaatggattccacctgtgtgcagagaggtgcatgggaggacaattatcgcagtactgtttgtgataacagaaaactggaaacaacctaaacgggctgctgtctccatccatgtgatggacctgcatgtgtcgtcagagaacaaagtagcgaatggtgatggaagtaaagctagcagtgacaaaatatttaccacgtgaccgacattgtctaagtgcatctaatcttgaccacaatctcatgagttaggcattttgtatccattttacaaatacaaaactaaggcagcaagaggctccatgactgctcagagtcacaccctagtaagggatagagctgggactgaactcctgctgttgggcccagcatccagtcccttggtctctacactgaaactgttcatccagatgtcgtgaaggacctagctctatatatcttggtaagggtgcagaacatgccaccatctgcataaaagggggaaatacacatgcatgtttgcataagtgcaagacagcactgtcctgtagaaccctctgtgatgatgggaatgttctatatctgtgctggccaatcctgtagccacaggtggctgctgagcacttaaaagattcctaatgtgactgagaaatggaattttgatattatttaattttaactaatttaaacagccacatggggctggtggctgtcgtatggggcaatgcaaggtagaatatagacagatggatgttaaagaaaagatcaccggattttgtggtttgcaatccctacttttaaaaaaccttctgcagaagcatcattggaagaacgggtttcataactgtttatttcagaaccactaatttaatctagccacttcatttgagagatgaggaaacttaaggcagaaaagttgagtcactttcctaaagtcatattcagctgcgttagtgtgaggaggaaggagcgggtcacagtttggtttggtttgttcctctttagagcatcggacattctcgtttgccaggggcttcattcaatctgatgtcagctcagttcttagcatggccggtcggttcctggaaatggcggctttgggtgaaaccatgtgctgtaagccatgggaactcaactctggcccatgtcaattagcctgcggtgaaactggttttgttatacagcgtgtcaccatttcacttaatgttacagtgtccaagaacctcccaacattaagtgaggacttactataaaagaaagaaagaaccagacttttgtctcctgggctcccagaactccatgaggaatcttgcagtggctcgccctttcctgaagccccagagttcatcctgcctcctgcacaccccaggctcaggctgtcctgcctgcctgcaccacagcatgggtgaaccatggtaggaccatgcttccctgcggtgtactcctcagcgcctcacacatggagggctttggaaatgtttgtgtggactctactcccagcctcgagggctgaaccgctagtgagttgtgcagatggctcatgaggagatttctccaacatttccttgagggagctgctggacacaggtaaacactcagcaaggagcagaatggggcttcagggggctgctagtccactgagcctgggtgactccaggaggagaggagccagcagagctatgcatgaccatgaccttttttagaagcagcaagcaaggaggaagagtggaattaatgaaaatgaggtagccaacttaacagaaaggcagaagaggaaagaaaattccagggaagtgtttccccagaggcctgagcatggtcctaggggtcagaagatggcagggaatcatctgggatccgaggtgagggcacagagaagacctgttctcaggacgccaaggaagaactgggaggcccctgctgagccgcggggcttcgcctgcgttcgggtgctgtgtgaggctagcactgccagtggaactgctgttgggctggaggaagtggacccagccagggggcaggaggtgttggccgcaggcccatgcttgcaaggcaaccagaccctgtgtcacaatgccaaagccagttaacctcggggaagaaacgccgtgggtggggacttctgagtgtttgtcaagtgaaaatggaggaagcaagaaagacagggccccagctgctcctgagatgtgtatcttctgtgattctgtctccagggagggactgtgcagcatctgcctgaacatctctgggacacagccgtcctctcgccataggaaggctcttgtccacagaggagtaaagggaagggcgctgcttcctgcaccagctcaccgtggccgctgtctccattttcgcagtctcaaaccctcggtgctttcagtgtggataaaagagtgggaggaacatttaaaaagtgaattattccaaattagtctctaaatttaatgcaattccgattaaaatcccaacagactttctttattcttgaacttaacaaagtaattaaaaattcacctggaagaataagcaactaagaagagccaaaaaagtttagagaaagagtgctgatgaaagtgggttgccctgcctgactggaaaggtgcaatgaagccacggcagaggagacccccttcacacgtcattctgcccaccgtagcgttgcagaagcaaagacacagtggaaacagccatgagcatggcccctgcagctcatgtttcagaatagtaatgacactgacttgaacgggttgaggaggtctgcatttttttaaatcttaaaagataagtagaagttgtcagatttgatttgggagataatgagccatataaaatctaaagtagaaaaataaataattggctgggtgcgtgcagtggctcacgcctgtaatcccagcactttcagaggctgaggcaggaggattgcttgacctcgggagttcaagaccagcctgggcaacatagtgagaccccatctctaagaaaagatgaaaaaaaaaattagccaggcatggtggcttccacctgtagtcccagctactctggaggctgaggtgggaggatcacttgagcacaggagattgaggctacagtgagccctgatcacactattgcactccaacctgggcagcagagccagaccctatcttagaaaaacaaacaaacaaaaaagattaaagcaataatatgaacaggagcagaaatggaaaggcattccaaggaatcccagagttattccatgagggacaaaaggtagctttccgctgccagagatgtgacttgccctttgcagcaaatataaaagaagtcacttcaggcattctgattgtctgtagctgtagagcaaaccaccccgaaacagtggattacaataacatcttcattaaccttatgaattaaatgtctttaatttttgccagtttgatgagtgaaaatgatattttaccgtttttattttctggtgagactgaacatcttttcatacatttcagactatttgtatttcctcttcagtacattacaggttcatttctctgccaatttttacttgagttgtttgtctttttctttgagacagagtcttgctctgtcaccctggctggagtgtagtggcacgatcttggctcacctcaacctctgcctcctgagctcaagcagtcctcccacctcagcctcccaagtagctgggactacagctgcatgccaccacatttggctaatttttgtatttttttggtagagatgaggtttcgccatgtttcccagactgttctcaaacccctggcctcgagcgatccacttgcctcaacctctcaaagtgctaggattataggcatgagctaccatgtctgtcctctttcttattgattacaggaatatattttgagtattagtcgtttgctatacatatattggttttaattttgtcatatagaaactttctttaagtcagatttcttaatcctttcctttatactttttgcattttgtgccttagatggctttctttccccaggattataagcctattcttctatatttttctttttataatgttataattttggtttttaagcttagccatctggaactcatctctaggaaacaagcgatgcgagactaatccctgggagaagggaaactcctgcagtgatggccagctcaccagctctctgcctgggaacaatatccacttcccagtgcagggagctggcctctgagcagagcacagcagccccactggctgaggaggcggtgatcagagaggggcagccaaagctgcacattttatggaatggggcatcagaaaggaggatgctgtgaagatagggggcccaggagtctatgtgcaggtctccacaagtcatggccaagggttgtgctgtccgtgtgcaggacgaggccactcgaggtttaccagatagtctgagatcagaacagaggtactaaaactggatgtgtgtgtacacttgtcccaggcaaggaccgaacactgaatgcacggcagggaaggagcacaggctgcatttgctgagatttcacatgaaatgttatgtgtgcatttgctttgtatcctctctgaccagaccttcaaagtaagtgtgatcctccctgggcttttattgcacatgctgagctccagtgaggaatgagctgcttttatcctctgtgatctgtaaactgttaaactttccaaaaactaaaaactcaatctgattccacagctgtgataataaagaccaattgggaaaaccccagagagattcagggagtgagactgtttagatcaccatgagcctgagacagctggttcctgcaagaatgaatgtacagcattttctaatcagtctcctgcctttttcccaagaagctttgcttttttctttttgacttttgcagttagtgtacacagagtcagttcattcacagacacctcatggaggcacctggaggtccttggtgaaggtaaagaagtactgggaatgcagccacggaatccagctgtgtcctcgattgaatttagcacagtacacaattcagtgtgtaccctgcagcttgtccccccagtgattgatgttttttaccaaatgttaataaccaaggcaaggcaagtaaccaggcaaccaaggcaagcgaaagcatcttctagaagcaaatgcgcaggctgtgtggttttgctttgccctgtcctgctgcgttattcatgagtgctgtctctacattcccccgtctgcaactttagtacaacctcaacactctgggaagatattcttggatatgcactaaaattagatttttaccttcccatgtgtaattcaatgtcttcatttttctcaaatgacttttgcttcattgaggtggacaaaattctgtatcttactttttttttttcctaaaccctcctagagacctataaccagttttggagatggttggactgttacccttttattaaacatctaagactttcatcaaaaagttccatattccactcagaaatattgctaaagtatttatatcctgggaaaagttaatttgtaattagtaactagcatttccctgggtaaaaataatcagcaagtttctttctgtttttgctccactttttcctccccaaaaatcttgtacataaattccaaatgttagtgttcagagtggacaccacactctagccccttaagacaatcagggtccttccctccttgtttccttcttccctccccctccctgtcctccctccttctctctccccttccctccctccctttctttcttccttccttcctttttttttttttgatagggtctcgctctaccacccaggttggagtgaagtgatttgatcatggctcactgcagccccagtctccccaggctcaagtgattctcctgcctcagccttcccagtagctgggattataggcatgcactatcatgcctggctaatttttacattttttgtagagacagggtcccgccatgttgcccaggctagtcttgagctcttgggcttaagcacctcctgcctcggcctcccaaagtgctgggatttgtgagccatcgcacatgacctcctttttaattgaggtataacatacacatgtgcatgggggatgctcacgaggtgacccaggtctagaaagcacagcattcagccccccagaatcctcttcatgttcccctggttaccagcttccactcaaggataacaatgatcctagtccgttttattcagggatgaatatcaaggaaaataccagaaggtaacagcctacagaatgcctgctgggctgcttttcattttcttctcatggttcttttgatgaacctctgagtctcagatgagtggtccttgggaaaagaccttaccatactaacatccctggggtggtctgtgtttcttcttagttttggctgcttctgtgagcattgaggactgtcgcgcagcagctcagccagatttcacccctctctactttaaggcctgtgccagctctagtcatcccctcgccaaaaatgagacttttcacctccatccaggggtaggtcctggagtgagttctcagcttgctccctggggtgcctaggacttgcccggccacccatgtcccacaaactgctgtttttctgcctggtgcccagtatattggccctgcccacacgagtaccttgctgccatggcttccttgacctctctggtcactgcagtgggactggatcttaacccacctacctgggacccacagaccttgcctagctcctggctgcccagggctggatgcttttccagtccaggaaaccagcccccaagagactggtgaatgatggcatgatcccatcgctgctgcctgcctcttccctccaacccccacgaactggcccccagggcccaggctgcaggagctcctggaaactgtgctagccccaagaaagtcctggctcctggaggactgatccccttgcactccttaggccatcggctgccgtcagcagcctcccctgcctcccctgggctctgctgatgagggtgcaacacactgcatagctcatagcctctgtacgtggtctgcaagggaacagtaatttaaatgacatggctttggccgggcgcgggtgctcacgcctgtaatcccagcactttgggaggccgaggcgggtggatcatgaggtcaggatatcgagaccatcctggctaacaaggtgaaaccccgtctctacgaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaatgacatggctttgaatgaactgagagctctgataaagcataactcaattcatctcttttctgcaagtcatcttccatccatgtggaaagtgtgaatgataccagttgtgccacattgatactgaccccctcgttcctgaaaatacaccttagagctcatgaaagcacaccccagttactggaaaggaagccacttttgttgtaagcacagcagcagagcagcctctgaggtgcacagggctctgcaggttgctgcttggccttatgtctgagtaaggcctaagtacacatagctttttttttttgttttatttctgagaaatttaattattttagttctttttttaaatcaacttttattttaaaatttcagggtacatgtgcaggatgtgcaggtttgttacataggtgtgccatggtggtttgctgcatagatcaacccatcacctaggtattaagctcaacatacattagtgattcttcctgatgctctccctcccccacccccaataggccttagtgtatgttgtttctctccatgtgtccatgtgttctcatttgttcaccttccacttataaatgagaacatactttgtttggttttctgtttctgtactagtttgctgaggaaaggggcttccagctccatccatgtccctgcaaaggacatgatcttgtttttttatggctgcatagtatggtgtatatgtaccacattttctttattcagtctatcactgatgggcatttgggttgattccttgactgtgctattgtgaatggtgctgcagtggacataacgtgtgcatgtatctttataatagaaggatttatattcatttgggtatataaccactaataggattgctgggtcaaatggtttttcttctagatctttgaggactacaaggaacttaaacaaatttagaagaaaaaaaaacaacatccccattaaaaagtgggcaaaggacatgaacagacacttctcaaaagaagacatttatgtagccaacaaatatatgaaaaaaacctcaacatcactgatcattagagaaatgtaaagcaaaatcacagtgagataccatgtcacaccagccagaatggcgattattaaaaagtcaagaaacaacagatgctggcgaggttgcagagaaaaatgaacacttttttttcttttttgagacggtatattagtccattatcatgctgttgataaagacatacctgagactgggaagaaaaagaggattaattggacttacagtttcacattgctggggaggcctcagaatcatggcaggaggtgaagggcacttctttttttttttttttttttttttttgtcccaagacggagtctcactctgttgcccaggctggagtgcagtggtgcgatctcggctaactgcaacctccgcccccccgggttcaagtgattctcctgcctcagcctcctgagtagctgggattacaggcgcctgccaccgtgcccggctaatttttgtatttttagtagagatgggatttcaccatcttggccaggctagtcttgaactcctgacctcgtgatccacccatctcagcctcccaaagtgctgggattataggcatgagccgccgtgcctggctgaaaggcacttcttacatggtggtggtggcaagagaaaaagaggacagaagcaaaagtggaaacccctgataaactcatgagatgttgtgagacttattcactatcacgagaatagcatgggaaagactggcccccatgattcagttacctccccctgggtccctcccacaacacttgagaattctgggaaatacaattcaagttgagatttgggtggggacacagccagaccatatcagatggagtcttgctctgatgtccaggctagagggcaggggcgccatctaggctcagtgcaacctctgcctcctgggttcaagtgattctcctgcctcagcctcccaagtagctggtactataggtgcacaccaccatgcctggctaattttttgtatttttagtagagatggggtttcaccatgttggccaggctggtctcaaactcctggcctcaagtgatccatccgcctaggcctcccaaaaagtgctgggattaacaagcgtgagctactgtgcctggccaaaaagggaacacttttatactgttggtgggaatgtaaattagttcagccgttgtggatgacagtgcacacggctttgaattgtcccccagctgcactggactgggagttgctggtgctcctgatgctcagctagaattagagataattttagatggcaactaggggactcggttggggttgttccactctgagatgaaagggaacgtctttatttaggagtataatgttcttggagcgagtgttatgtcacaaaccatagttgggtggcctctacctctgccaacgtcagcaataaaaagtctgaggcagggaaactttttagagagaagaagagtgtttcctgatcatgggcttgggcttgtctacctgactagatttggacttttataataattcttttttaagatggtacacattctcctttttcctgtgttgtttctctgtggtctcactgctgcagtgccaggatctgcattcaaatacggccgagcccccagagcaccaccagtgcagtctgtcctgaggcactggactctcagagctctcctgcgggtttcagtcattttgtttggtttttcaaccatggctttgatcttgccagactttagtctcaacctgtgacccatttatagttacagatcaagaactagtggtcactttggcaacatacataccaacatggaaatgatacagagaagactggcagggaccctacacaaggaaaacaaaaaaataacttttttttttttttttaaagagagtctcactctgtcacccaggctggtgtgatcatggctcactgccaccttgaatgccagggctccagtgagtctcccacctcagcttcccaagtagctgcaactacagacatgcaccaccacacttgtctgatttttatttttatgtattttatatttatttttttgagacagggtttcactctgttgccctggctggagtgtagtggcatgatctctgctcactgaaacctctgcctcctgagttcaagcaattctccctcttcagcctcctgaatagctgggattacaggcacacaccaccatgcctggctaatttttaaatttttttggtagacgtgaggtttcaccatgttgcccaggctggtctcgaactcctaacctcaagtgatctgcccaccttggcctcccaaagttctgggccaccactctgagcccaaaaactattcttgacagtgttcaatgaactagcatatgggcgccttcttggttgtgggagatggtggcattgttgagcttccggatccatctgacctctcaaatgcttctgaagattttgcagatgaagaaaaatgctgttttgtatcagaaatgatagaagatgtaagtgtgtatataatgttctcatgtttttggaaaagaaggatttagcaagtgttaaagtgaatttgggaagggagcgaggaagggtgagaaggagaacctggcccgtttggatgcacaagttccttggggcggtagcattcaccagtgcagagagcagtgccatccaccccagagtctgttcctggtgggcctggcctggcctcagaaaatggggttctagtttctttaactgacaagaaggaatcaaagtttcaccactcactcctctagaatctgccctctcccaccctcagcctttcctttcactcttgtcgaagacatgaattgagcaagctgcagggcctctttcagcagggtctgctggcagtgtccactgcaaatgggacatgtgcttcagaggcaaatggagctggcgttctggccctgactctggcgctagaaatatttctttttgttctggctttcttatctgtaaaatgggtataacactagtcaccgtgcatggctgtaaatgagaaaatgcacagtgacaggcttatcacaggcactcagcaaatgccactgcccttcccagcccaccattttttttttaaaagacggttttgctctgtcatgcaggcgggagtgcagtggcatgatcttggctcactgcaagctccgcatcctgggctcaaacgatcttcctgcttcagcctcccaagtagctggaactacaggcatgtgccaccacacccagctaatttttgtatttttagtagagatgggatttcaccatgttggcctgtccggtctcaaacccctgagctcaagtgatctgcctgcattggcctcccaaagttctggggttacagcgtgagctaccgcacccagccaagggactcatacttaaaggactttggtcttgctcattgagcatttggttttctatttaaaatgtggtctttctgttggaaacgatctagtatccgtcagcattgctcttgggaaagaacacttccaggcagggcaagcacttgccttgtgtacacagatgccttgagatcagcataatgtaaacgtcaaaacgggtttctggatctaaagcctggcttgctttcttccaggtcagcagtgcaagagatgggtttggagatagggtcgcagccagcctgtgcgtggcagaggaaggaagggggagctgagtactggcaggggccacagtgctctctgcccttcccaagaggaaagcagaaaccagaccctctgttagaggccctccttgttttcaccttcccagggtttgatgtccataacatctggtttgaatgattccagcgaactggatggggcaccccactgccccaccaccgcctgttttttcatctttttttttgggggggggacggagttaatctctgcaccccagctggagtgcagtggcgctatctcagctgactgcaacctccacctcccaggttcaagcaattctcctgcctcagcctcctgagtagcggggattacaggtaccagccaccacgcccagctaattttgtatttttagtagagttgaggtttcactacattggccaggctggtctcgaactcctgacgtcaggtgatccgctcacctcagcctctgtaacctacaaacctcttcagaaagtgtaaaatgaaagcatttccccatttctaaagcagtgtccaggtttcatcaggtagctgtcgaacccaaagagactttgaagccaagagtccacaggatcagcttcccagtggccccagaagttacaagatggggccctcccaacaaaaggcatcctcaggcttttacgtaatgctggtgtgcttagcgactgctgaaagttgactgtgcttgtgtcgtgaaagccaagatgaagagacgttattatggttgtgtgttgctttcagctagatactcctcgctggggaaatgtaactgcaaagcagactccaggacactgtcttcctgaaagccggtgcttttgggggacattctggggcccaccagggtcatcctggatgctgactggaactgagaagaggtttgctgggaagatagggacagattctttgtatctatgtcattcaggtaaaccctacatgtgacatgtgacaccatctcttttgacctcagtttcaaatgagatatttgaccaaccttattgctaagggtcaggctagcttgaaataaccctcaagaaatctagataaaaacctaaatgagattataggctttttttttttgcctaagattatttgcttccagaaccctaaggaaacttcacaggaaacatggtaccatattttagtacacatctccatcctatgcatgttctccagaacctcttcacacacactttgaggagagttccatcaaacctccttctcttattccatcttaatgtcatgcattatttctcttcatcctgcctctccttttcagttacaaattgattctgatagaaacaccctaaatgaccttcccagggcagtcagagagttaacttgttgtagggttgcatttggccatctgggcagagggaggaaacagtggtcagtgtccaccctgtgggagggaggcagcacccaccacagctttccaactttgctggcttcacatttcccaggacagggcaagaagaggaagagctcctcagtggctgtggggagagtgcaggaaggagccctagacttgcccatttcttcttgtcccaaaacccaacacagacctaaaactcagccaagcccaagctatgccccgcttctgcaatctcttgcaaggcccctgcttaaacaacctgagctcccagctttagtaggcttgggaacttgatgcttcatttgggacaaactttgtggatccagggaagaaaaccttgttggggtgagcaggtggccgacaggactgaggatctaagaggtggggatgcactggagtccccagctggcctaggggaccggtacaggagtcttcagaagccaccatctcgatgggcagggacttagaattgaattttttttgtttttgttttttttgagacagaatgtcacctaggctggagtgcagtggtgcaatctcagctcactgcaacctctgccttccaggttcaaggcatttgcctgcctcagcctcccaagtagctgggattacaggtgcccaccaccacacctggctcatttttgtatttttagtagagacggggtttaaccatgttggctaagctggtctcaaactcttgacctcaggtgatccacttgcctcggccttccaaagtgttgggaatagaggcgtgagccaccatgcccagctagagttggattttagtttccttatcactgtgtaccaagcagctgctgggggctgcacccatcccgatggaggagcttctttctccccatgcagcctcatgctccctgcttgtttggtgtgctgacggggctgctgaacaggacgggttttcttttccccctgagaagcctcctacattgtggggagaagagtgtggtaggaagagcaatccagagacagtcttgtaggtctttaagaccttctcatcttggtctgcttgttgcgaattggggttatacagagatggtgatggtggtagtgatgacggtggtggggatgatggtcatggttatgaaggtaatgacgacggtggtggggatgatggtcatggttatgaaggtactgatgatggtggtggggatgatggtcatggttatgaaggtactgatgatggtggtggtggtagtgattcctccttgaccaaataagtctgggaaatgctggcatgtacaaaactaatcaggtgggttaatttgagaataagatatctttgagcctttaatgactctcctgagggatggacagaaatcctctactgttttgagcactgaaggcttttcctcaatactattctgtgaatggatttgggcaacaccaggccattcctggtaccaaaacaaaatgtactctgagcaaatttgggaagtttattcttatgttgccttactgaaaaatccaaaggtagattcccatctattattattattattattattatactttaagttctggggtacatgtgcacaatgtgcaggtttgttacataagtatacatgtgccatgttggtgtcctgcacccattaactcatcatttacattaggtatatctcctaatgctatccctcccccctccccccaccccatgacaggccccggtgtgtgttgttccctaccctgtggccaagtgttctcattgtttagttcccacctatgagtgagaacatgcagtgtttggttttctgtccttgtgatagtttactcagtatgatggtttccagcttcatccatgtccctacaaaggacatgaactcatcctttttatggctgtatagtattcgatggtgtacatgtgccacattttcttaatccagtctatcattgatggacatttgggttggttccaggtctttgctatagtgattagtgccgcaataaacatatgtgtgcatgtgtctttatagcagcgtgatttataatcttttggatatatgcccagtaatgggatggctgggtcaaatggtatttctagttctagatccttgaggaatcaccacactgtcttccacaatggttgaactagtttacagtcccaccaacagtgtaaaagtgttcctatttctcaacatcttctccagcacctgttatttcctgactttttaatgatcaccattctaactggtgtgagatggtatctcattgaggttttgatttgcatttctctgatggccagtgatgatgagcattgtttcatgtgtctgttggcagcataaatgtcttcttttgagcagtttctgttcatatcctttgcccactttttgatggggttgtttgattttttcttgtaaatttgtttaagttctttgtaggttctggatattagccctttgccagatgggtagattataaaaattttctcccattctgtaggttgcctgttcactctgatggcagtttcttttgctgtgcagaaactctttagtttaattagatctcatttgtctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtctaaggtgtaaggaagggatccagtttcagctttctacatatggctagccagttttcccagcaccatttattaaatagggaatcctttccccgttgcttgtttttgtcaggtttgtcaaagatcagatggttgtagatgtgtggtattatttccgagggctctatgctgttccattggtctacatctctgttttggtaccagtaccatgctgttttggttgctgtagccttggagtatagtttgaagtcaggtagcgtgatgcctccagctttgtgctttttgcttaggattgtcttggcaatgcaggctcatttttggttccatatgaactttaaagtagttttttccaattctgtgaagaaagtcattggtagcttgatggggatggcattgaatctataaattaccttgggtagtatggccattttcatgatattgattcttcctatccatgagcatggaatgttcttccatttgtttgtgtcctcttttatttcgttgagcagttgtttgtagttctccttgaagaggtccttcacatcccttgtaagttggattcctaggtattttactctctttgtagcatttgtgaatgagagttcactcgtgaattcggctctctgtctgttattggtgtataggaatgcttgtgatttttgcacattgattttgtgtagattcccatcttatcacaatcttcctcatctgtgatactgcacagtttgcaatagttcttgtttattactacttttctctcctgcagaacattgacatcaccaatttcagcagcagctggagcgatggcctggccttctgtgctctgctccacacctacctgcctgcccacatcccctaccaggagctgaatagtcaggagaaagtaagtcatggccctgtcaccttggttatcctctaagaaatgcaggagtcctaattgataaaccccactgtgggagggggcttacaggcctgaagtagaagttgggatattgataccaggtacagataactcctgaatgtttgactgcaccgtggaatcccatcctcagcaaatcttcctcagtttcccttctcaggaatctcagcttcatggtttcaagaccttggccagcatttttcaaagcctattccaaagaaccagcaagcaccaacaaaaagaattccctgttcaaataagtcttggacactgtatattgcatcacattttcagagagcatggtgcctgttaacacattaaagacttcaagaagtcctacattaagaaatctatgtgactgtttaacacagcatagatcagatccacttaacctctttacttatatttgtttgttttactacaatcacacaacaagggttggcaaattttccctgttaagggccacgtaatagactcagtgggtcaggtggtccagtcacaactgttcaactctaccatcgggctaaagaggccattgatcactttgtaaatgaatgtgcatggctgtgtcccaacaaacctttatttacaaaaacaggctatgagccagatttgggacagcagtttgccaacccctgacctagaacctcctacaaaatgtcccacagagcatactttggaaaatactgtgctgggtcccgctgttggtcactcaagaatttcttgtcaagcatcgggcactatcataagaaaacaggcaacaatagagacgttctatgccctcatgagctagacagataataagcaagcgagtagacttataacaagtaaaattataaattagcaaggataagtggtctaagagcccagagagaaactcagtgctgtgagacagagtgacggggatcacatttagaccagggagactgcagcggtgatgtcagaactggtgttggggctgggcatagtggctcccgcctgtaatcccagtactttgggaggccgaagcgggtggatcacttgagttcaggagttcaagaccagcctgcccaacatggtgaaactccatctctactaaaaatacaaaaattagctgggcatggtggtgcacacctgtaatcccagctacttgggaggctgaggcaggagaattgcttgaacctgggaggcagatcgcaccactgcacttcagcctgggcaacagagcaagactcctcaaaaaaaaaaagaaaaacaaactggcattggaaggtagaggaggcagcagtgcagagccagggctatggagcagcagcagctggggaacaccttggtgttgtccaggccgtggaagaaggctggttggctggatgcagttagtggggccagagaggctgtgctgatccagggaagtggagggggcagacccccatagctgggctgatctggggagtctggggcgggagaggcgacagagcttccccacagctctggtttggcctcacccactaaccatgagggtggtagcaacgcagacggaaagacatagaaggatttgaaatatgtctcagacagaatcaactggatttagtgacagattggttgtaggggaggaggagaggaaggagtcaaagatgacgccctggtgtctagtttgaaagggccattttctgagatggggagggcatagatatgtttaaaagctctgtttcgattatcccacatcaggatttaaataaagtacaaagaaggatcatagcaatgacaaaaactgagcaaagtaatttaatttttaaggtgttagaattctccaaaaaagcagaaccaaaagagagagagagagagagagagagagagtgtgtgtgtgtgtgtgtgtgtgtatgtagagagagagagagagagaggtgggggctggggagagagatttattctaaggaactagctcgagattatagaagctagcaagtccagcatctgcagggtaagccagcaggctggagactcagggaagagctgatactacagtcccaatgtgaaggccatttgctggtggaattccctcttcttcagtgaggttagccttttcttttaaggccttcacctgattagatgaggcccacccacactaactggggtcatttgctttgccgaaagtctcctgctttaaatgttaaacttgggccatgtgtgggggctcatacttgtaatcccagcactttgggcggctgagacaggaggatcacttgagcccaggagtttaagaccagcctaggcaacataggcagacctccatttctacaaaaaaaattttttttcaattagctgagcttggtggcgcacatctgagatcccagctactcaggaggctgaggtgggagaatcacttgactctgggagtttgaggctgtagcaagccatgattgtaccactgctctccagcctgggtgacagagaccctgtctcaaaaaaaaaaaaaaaaaaaaaaaagaaaagaaaaaaaaccttcacagaaacatctagaataatatttggccaagtatctgggtgccatgcctatccaagttaacacatgcaattaaccatcacagaatgtattaaaatatttaaattacttttctgtggggtgctttgtttgtgaagcaggctgtacaggattattaaacattctgggggaaagattgtatttaaatcatgtgaagtctgaggggctgtgaaatatgcaggtggtgatggcaggcaggcgattgcacagcaaatccggagctggatgggagagcagagcttgaaacacagatctgggggtcgtccatgaagagatccatgctgtctaatgcaggttcctgggatgatgggaatgttgtgtatctgcactgcccacagggcaaccaccaaccacacctgcttttgagcacttgaaatgtggcagatgtgactgaagactgaatttttaatttcaattttcatgttaaataaccacatcatgtgtggctgccatgttggacagcatgggcacaaatggaatttaaagccattaagagtggaggagagcacccagtcccttggtcttagggaagcatacagagggaggaccgaggaacacacctgggaaccccagtgtttgttgtggaggtagaggaggaggacacagcaaaggggaccaggaaggagcagccagagaggtggcctgagctggggccacaggcttcagcggcctcacgggtcacaggtgtcatctatgcatttattccctccctgccctcttgatgtcttagtgtctgcttttctgatacgatgttggagagataactgaggaaatagtgggcataaaagcactgaaaatagtcagaaggcctttctaacactgtgctgggtgaagcccacacatgcacacacctacgtcctcctgacagtgtgtgtgcgtcactccctgcagtcatccagacagactggctgctttgtccttgaatcagcatggctgtattggaaaattatggacctaaaagtgtttgttctcaggctccaaattgtgagccttgcctcctgggccagagcccctgtgtctggccctagtctctgcgattctgagcgcagaggctccgccagctgcccaggcctcccgcagccgtggcagcatgcagtgggggcaggctgaggccatggtataggcccctgctccctacatgcagggttgaatttcttccccagaccaatcacccgaccaccagggagtgtgtaaggcagcgtgtggaagactgtgggtctgtgatgagagtctgagtcagccctggatgtctggaatttttcattttaggatctgtttggcctcacagtaatcttgaattgggttgtgtcccagagcctaggattttatttgctaattacagcccgtttgccactctctgaaggaacaaccagcctcctgtttcctaaatgccccatcctggccacactctggaggagccacagtggctgcagtgacatttcgccacttcttggtgtgtggcttgccctgggggatgctggcgttctttttggtgagagaggccatatctatcacagttacgggtgtgggttttcaaagtaacgtatcccaacaggcagactcgtaccatataaaactgagcacacggggggaatcttactagagcagagaggggaaagagcaggaaagatttcctaaaagtgtgttagaagctgggattcacagggagcaagtggatgtgaatacagcacataccttgggtcatcaggatgagaggcacatgtgtccagccccagcctggagccgtgttcccctatgtgctcagtgccagggcatttttttttttttttaatttacacttacatcagaaagggcaccaagagaagcctttaatgtttgtaaaactattaaaatcaaaatctaaaaagtatgtgatagagttgttgatagcccagaatgtatagaaattatgaggtgtccccacctggatggaagcaattaaactatgtctgacattggtattaagtagagaatttctgataaaaactaacaagcatgtcttctatgatagtaaagagatatatgatcacagggtgcgatttacagtccatgaaagattttgtcattttgttgttgttgttgctgttttgagacagagtctcactctgtcacccaggctggagcgcagtggtaccatctcagctcactgcaacctccgcctcccaagtccaagcgattctcctgcctcaacctctcgagtagctgtgactacaggcacacggcactacacctggctagtttttatatttttagtagagatggggtttcatcatgttggtcaggctggtctcaaactcctgactttaggtgatccacccgcttgggcctcccaatagttctgggattacagtggtgaatcactgtgcccagccatttttgtttttattgttttcagtaaaaagatagggcattcacttgtccgcctttgcaactctctgcttagtccagacggactcaggtagtggactggaccttgcttatgtcagtatctgaaatgaatgaagtgtgaccctgagagggggaactctaggattggcatctttctcccgtcggttttgagtgtgaggcccaacgggcccaacccctcaatccctgctggtgactaagagttttgccacaggttgggcacttaggctgtcctggaactggaaggtcccaggcctgcaccatcatcccccgaccagggcagactgaagcagtgatggcgtcaccctgcccggctcctgtgggctgagctgcatctgaagcttacagcccgtgggggaagtgaggcccttcggagctgctgcttgtctgtggcttctgcctcccaggtggcctctgcacagtggtggtgacagtgatcaaatgaaagagcattgggataataacacttggtcacagatgttctgctgctgcaaaaatgaataaaagttactgttgtgaataaaaaaccaccccctctctgtattctatgtcaccctgtatactatttcagggtattttgagacagtttttcatcaagggatcctcccacctcaggcttcagagtagctgggattacaggcatgttgccaccacgtcttgctccgcttgtgttttcacaacagatactgaacatagaagaaacagcatgcagcacactgtgaaaacacagcggtgccaggcgttgtggcaacatgcctgtaatcccagctactccagagcctgaggctgggggatcccttgagcccaggattttgaggctgcagtagtgagcccatctaaaaaaaaaaaaaaaaaaaaaaaaagaggaaagaaaacaagtggtttcattagaatcaaactagaaggtttttgcataaaacgttgagtttaaaaatgctttctcgttagaccttactagtaatcaatacaaattaaaacaataaaatatttttagcctgatacatttggcagagacagtacaggaaaatagccacttatacactattgctggagccaaaaattggggtaacgctctagaaagcaatgtttggcattacatattaaaagccataaaatatttgacttctggaataatggtggcctaaaaactggctaaaaaccaaaaggactgaagtaaacacaaagacctcaatagcaccaaaataggagattgctgccattaatttgggctaaatggaaggaagccaggagttcacagctcccctctcagcagaacagagtagtgttagggtaacaagtgtgcagtttccagcccatgcccgctcctttcctttaatttcaaggaaggggcatggcagcttgggcaggatcaccacagatcaacagctttccaaggcatgggccacagactggaagaaaatgtggtggctacatctttctgtttttttggtgacctggtgcctagagtttgcttcagtgtcagggaaaacccgtcgcttcaggctctagatgttcaagcaagggtagagagtgagagccgtgggggaaatggaaaagggtataaaatgatgtatgaaatctaaaatacataattatgtataaaatctaaacatacaaaattaagaaatttggacaggtgctgtggctcacgtctgtaatcccagcagttcggaagactttgacaggcggatcacctgaggtcaggagttcaagaccagcctggccaatgtggtgaaaacctgtctctactaaaaatacaaaaattagccaggcgtggtagtgggcgcgtgtagtcccagctactagggaggctgaggcaagggaactggttgaacccaagaggcagaggtggcagtgagccgagatcgtgccactgcactccagcctgggtgacacagcgagactccatctcaaaaaaaaaattaagaaattctactgaggaacataatggccaggtgccatagctcacacctgtaatcccagcactttgggaggctgaggtaggcagatcgcttgagcccaggagttcgaaactagcctggtcaacatgacgaaaccccttctctactaaaaatacaaaaaaaaaaaaaaaaaaaaaaaaaagccaggtgtggtggtgcatgtctataatctcagctactgaggtaactgagaaacgagaatcacttggacctgggaggcagaggttgcagtgagctgagctcaagccactacactccagcctgggtgacagggcgagattccatctcaaaaaaaggaaatttcactgaggaacttaaaactgaatatgtagagaaacatttatatctcaattatacttaatataacaatttaattttaatataatcctaataattttgaaatgaattttggaatgggagaagcatgaacaaatgattcttaggttcatctagatgaacaaacatcagagaatagccaggaagagtccccaaaagaagccacacactagggctgaatgattgtggagcactaccattaacattctaaggggaaattattttcagcctcagattccctgtccagccagcctgttaactgaacgtgatggtagaaaggagaaattttcatacatccagaaaatgtgtctccccatattctttcttaagaaggaacctaggcaatagaatgggggtaaaatccaaaaatcagtgaggttctggagggcttggggctgtagggtttcatagaatgatgagatgattaagagctcgaggctgtgataaaggagaagatgagaaactgtgcgaggaagccagggtccaactatgaggcaggccctctgtgtcagaatagaatggcggcagccacaaggagaatgttaggacttaaaagcaacagtcagaatgggcaagaggccagatgagaaggaggcacaaagcccccctcccagtaaggaaaaccccaaacaagcagaaactgtaggaaaaaaacaaacttttgaagaaaggcagggtccaaatctggggcacactaaaatgtggggtgattttgggcgactggtagagtaacagaggaactcctttaaatgatgctttgagtggctcaggtcatgatggtggagctgtagaggacacgtgcccacagctggcttctgtgatgccgcttgtggttttcagcttccagaatcattctagtcagagagcgccgaggacttaaatgtgcttccagggaaggaagcaaaggttctcagctgtgacaatgtacaacttgaccaggtggagggaagaaagggtaatttactcctgacatacaaagtagagtcaggaagtgttgtccatacccagtgggacaaaaaatagaagttcaaggatattatttaaggtcacaaacatagctaatattaatacgggcactaaaattagctatgtgtctatagtgtaaggaggaggcagatgcatggtgcctgagtcctcatatgtcctggaggaagtcagtagaaaatgccttcattttagaaatcaagtagtagtcgtattagcatattacagagatacggaaataatccataactaaacagaaattgaaaggtagttctctgaaggaccaggattgaaggaaggaacaggttttcatttgatttaaatacaatctatatatactataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattgacatctgtttgccgaaagtctgttgctctcaatacctaatatagagttatccagttgatataatcacatatcaacatatgatttagagattttcaatcgcataagatttcatatggacaaatttcagttctggaaacacagtggactgaattattattagagccctcttgttcagaacacctagaaatctgaataaaatgctatgttaaaaaatatcaacacatagctaagctcttaataaagaatgggaaatacccagatgccagaaatgtaaaacaaagcagaaaccaggcacaactgagcctgcaaaactcggcaggggtgggtgggggatggtgggccaagcaagcagcaagcctgcataaagccaaggctcacaacatgctgatcttcttagtgaaagcagaaatctctaaaactccaccagccagcccagggaggtgataaggaagctggtttccacctgggattgtgtgcgcacgtgcgcgcagagagaggaaaaggagagagagaaaagagagagagtctcttgcaaggaaaggaaacagggccagatgaggtttagagtccaaatttataatatctgtgctgcatgaagcccttagtatactcttagatgcaggaagcccctgggctgatactacaatggctgctaaaaagtaacagaacacttgagaaaatgatctacttgagctagtcagcagatatagcaaacaaaaggattatctaccagaacttgagatgataaataagagactaccaaaagactatttaaacatgaaagagataaaaggaggaatagaaaccacaaggaaagaatgattctatttaaaaaagagatttgtaaaaagaatctaacacttctagaaatgaaaaattggaattaagaccacaatatgtgttgccaaactcattagatacagcagaagagagaaatactaaattggaaaataaatacagggagatcacccaaaatataaaagagacattaaaaaatataaaatataatggtaaggttgaattagtatgtgttcagcttcaagaaatggaaaacccaaccagcagttgcttaaaccataaaaatgttaattttcttaacaatagtagttttagaactggttcaccactcagtattgtaatcaaagccccagagtgtctcctctccattctcaccatctttaatctgttccttttgtccccatgcttgttctttgtggttgaaggtggctgccaaacttcagacatcacttccacctacagggcaggaagaaggggaagagagagagcaagtgcctcctatctttccctttaaagaatgaaagtgaaaggctccctgggtttctccagctcattggcagtactctgttacatggtccccagctgcaagggcatttgaggaagtgagcatatgaacagttttcagtttctttagtgggaagcctgcgagggagagagcttgggaatgactgttgggctatctaaataatagtgtctgtctcagagtttaagagacagggacaaaaaaaatcagacaatggccatgtcccatgcccagagggaattccagatgaaaaggatagaaagaatggaatggagacagtatttgaagatatgatgcctgaaaattttccagaatgatgaaaggataatgaaagagtccacagattctttatttatctcaagcaggatgaataaaacaaaatatccatctagacatattgtaatgaaactacagaaaaagcaaagacagataatctattaaaaatttctgctcaccagtaataaaaatacaacctagtaggaaattatcaaagactagaagagaaaattcacagatgatgatgatgaatggtcaatgaggatttttaaagatgttcaatctcattagggattgggaaaatctaagttgaaataaaaatgagataacaattccagctgggtgcagtggcccacacctgtaatcccagcactttgggaggctgaggtgggtggatcacctgaggtcaggagtttgagaccagcctggccaacattgtgaaagcccgtacctactaaagatacacaaaattggccaggtgtggtggcgggcacctgtaatcccagctactcgggaggctgaggcaggagaattgcttgaacccaggaggcagaggttgcagtgagccaagattgcaccattgcactccagcctgggtgacaagagcgaaactccatctcaaaaaaaaaaaaaaaaaaaaaattccataaccctcaaagcatgtggggaatctgagaaatgaaaaagtgaatgtacatctattgtgaaatcttaccaccatgaacagtgctatgccagtgtaattttgaaacagaatggacagttttctagaaaaatacaagtatgtttcttcaaatattaaatgtaaatattcctatgaaacttaagaagacataaaactttaaccattgaagaggttgaatttatgctttaaaatgtagtcacacacacaaagaaaaaatatccccatcagcccagattttgctaaatctttaagacgcagatatccctattgtgtatttacaagtctgggaaatttaaaaaggtgtgaggaaacttacacatctgaccagggtggagtagcagggatctcccttcagaaacaacaaaactaaggagtaccaacagagagatcaggtaaggataaagatacaatgagaccttgttggaagattatattttacacagaatacatttttctttgtagtgttgtaattaatatttacttctgtttaaatataatatctttttcttaattttcatctaatgtgctatagaagttagtgagctgggaagtgaatgaggtcattttgttgtcctaattgtcagagccaggggtttcattggtgtggatggtctgtgaggagctgctgacacacatgataattaatctcaaaggcacttaggagtgtttgtgagcactttcccggctttttccaccaacaaaatagaaatttcctacattcttaaatttgcttttcagtaccttgatgtggattggaaaatccagtatgttgaattacacatgacactttaaaactacacccagtcagaagtgacagcagtaatccccaaatcttcagtcaagttctgttgttagattatgccaggaaaattgtcttatatgtttatattcaagtaaatataagtttctggggtataacatattaggatgagatctttatttttataatttcaacttttattttagattcaaggagtacatgtacaggtttgttacatgggtacactggatgatgctgaggtttgggatatgagtgatcctgtcacccagataggcacatagtagccgatagtttttcagcccttgcctccctccctcctttctccctcttgtagtccccagtgtctactgtccccatctttatgtccatgactacccaatgttgagctccatttataagtgagaacatgtcttatttggttttctgtttgtgcattagtttgctgaggataatggcccctagctgaatccacgctgctgcaaaggacatgattttgttctttttatggctgcatagtattccatggtatatatgtaccacattttctttatccagtctactggttttctttctccttttcttttttttttttttttttttgagatggaatttcgccttgttgcccaagatagagtgcaatggtgcaatcttggctcactgcaacctccgacttccgggttcaagcaattcttctgcctcagcctcctgagtagctgggattataggcacgcaccaccatgcccagctaattttttgtattttttttagtagaaatggggtttcatcatgttagccaggctggtctcaaactcctgacctcaggtgatccacccacctcagcctcccaaagggctgggattacaggcatgagccactgtgcccggccctttatccagtctactgttgatggacacctaggttgatttcatgtctttgctattgtgactagcactgtgatgaacataagtgtgcatgtgtttttgatagaacgatttcttttcttctggatatatacccagtaatgatattgctgagtcaaatggtagttctgttttaagttctttgagaaatctccaaagtgccttccacagtaactgaactaatttacatttccaccaagagtgtattcccttttctccacagccttgtcagcatctgttactttttgacgttctatcaatagccattctgactggtgtgagatgatgagatctttaaaaatgaagctctatagtgttccccagatattagaaagtgttctttctcagccaccgtgtaaggagagcatcttagccagcccaattacagatgcaagcaactccccagaaaaggaattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgcaaggtggatgcactctataagaggaaactgaggcacatggcttatgagcgggaaaggcaagaggcaaggccaggcaggcagctccagagcgcatgccgtcaaccaccctgacagctgtgtctgccttctgcacataccttgttagatttagaccttagtggggtttttttttttttttttttggtgctattgtaaatgttattgtttttcttattacaaaatccagttgttcaattggtacataggacagcaatggacttttgtatactgaccttgtatcctgagacttagctaaacctgcatgtaaatgctttgggatttttctaaacaatcatatcatctgcaaataaaggcagttttatgtctccctttccaatctgcgtgccatttgtttctttttcatgccgtttagcactagctagaacttccagtacattttttttttgtttttgtttttgtttttgtttttgagatggagtcttgctctgtcacccaggcctggggtgcaatggcatgatctcggctcactgcaacctctgcctcctgggttcaagtgattctcctgtctcagcctcctgagtaactgggattatagacacctgtcaccatgcctggctaatttttttgtatttttagtagagacggagtttcaacatgtttgccaggcctgccttgaactcctgacctcaggtgatccacccgcctcggcctcccaaagtgctgggattacagtccagtacagttttaaataggacagatgagaaaggacatccttgccttgttcatgattttacggggggaatgttcaggtctttcaccattaagtatgatgtcagctgttggttttttatacatatcctttgctaggtaaaagaggttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaatagattgtgtattcatgagaaattggcatgtagatttcctgtaatgtttatgtctagttttggtatcaggataatgttgggatcctggaatgagttgggaattattctctcctcttccattttttgaagagattgtgtagaattggtattatttcttccttaagtatttgatagaattcacaagtgaaatcatctgggtctggtatcttttggagggtcttaactactaattcaaacaaatgtcatgcactataagattgttactaatgcagcatactctgtcttctgaaatgtataacatcttttcacaaattctcaaatatgttaacaatgtactaaatatttttagttcagttatgaagttcaagcatgtaagattgtctgctcaaaactgaatattgattggacttcggagtcctctctgagattaaagacacaccctttccataatacagaggaaagtgtgcagtgtgccatctctcttgtgtttgtaggtatcccttcttttcccagagctcatctatgtccaaattgcatgcccaattcttcatcagttcctttctgtaagtcatgttagcaacactccttggtacggattttaggttgccaggcctcagtctgtgtgcagtcatgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgcatgctcattacaagcttacttgcaaaatgaacaaaaataaatcagtcagtaaaaaccagcaaattagcaaaagtaaaataaaaataagccaaaaaatcaccaaactgtattaaataacaaacaaacaaaaaaacacattaagtagtaacaatgctggtaaaataaatggttgcatttgaaattggttcaaggcttttgtgataatcccactcagtaatttatcttgagggactagttcgacagaaggaaacaatactgcacaaagatgctgattgcagagtctgtggtggtcacgaggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaacgtg

SEQ ID NO: 492 - DNA, 227733 bp, Homo sapiens
agaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtgacttctgctgatgggatcaatgaattttactttggaatttttcttctgatgctgtatggaaatctgttcttttccttatttactgggaaagaatctgaggctattgggatgatttttcatctcaagactgtgggaaataatcagctttgaagcatttcctgtggccatttgctgaagtctgggattccgtcagctgcgccccaaccagattttcagtgttaatgtttccatgttaggtggtgaggctaagcagatatgtcatgtgccggctggtctaggagccagtgtcccagggctctcattcttcctctggaagtctctccaccgtggcactgctgacattgtaggccagatgcttccttgttgtagggctcccctttgggttaccgatgtctagcagcatctctgggctctgtccagtagcaccccaagttgtgacaccgtaaatgcctctgcacattgccacgtgcccattgggcttagaactactactgtagaagaggtcaggagcaaattcgacccatgttccaaaaagctccagctcagtattttcaacatgtggttcacttacgttctatttcctgctgagtcccctggcaattgagctatgtgcacattcttattttgttggttctcagacttgaatggtttggcctcttccgcttcccagtgcttattgtgcttgtagccgagccctgagtgccctctcccactcctggagactcgtcattattttctgattgtccagaatggtttcccagttgcctttctatttcttgccttaaaaggataatgaagctgaggcccgagataacctctccaacgcaggctccgaaggcagcaatttagtggcggaacagcgtgttttcagggagcaggagacgtgtggactctgactttaactgttgcccagcgcctaattgtattccttaaataggggttccctctctcctccttttctccctccctcctttctcttctactttacactgtgaaatttaagagttgcagtttaagtcctacactattctggagaggagagaaacttggtaagaaaataaaatgtttgacaaatttaaagaaaacacccctggaacgacatcccccaccccaccatgggtgtggggtcctagatttaactgtaattccttgatcgatgtgatcctttgtggtgttcatgaggattttaggaaatcatgagattaataatagaaaccttcttttcactgtcttgtacttggctggagcctgtttattttgtatggctaattcatatccataagaaaacgattactcagctagcattcccacctgtgtttatctttcagcagccaggatttgttaagccctgggcaattttaattgctgtgaagtgtcttccctgcaggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatcaacagtttttgtcgagagggcggctcatagttgtcaacagccttctgtgtgcctggcacctgatggacttgttctcctttcatctttacagttttatgaagttggcactgataactccatcttattgggtgaagatgtagagaatcatgttcagaaagcatggctgagttcacaatgtcaacagtggagctgaatttggaccaggtgcatttgatctatagccttggtgctctccagggagcaaagattattcagagaggccatccgtccctggtgtttaggtgtgtaggttttggaaccaatttaaactggatctgaatcttggctccaagataaactctgagatttgggcaagttgcttaacctcccttggggaaatgaagtttccccacctgtgaaatggatatgtcttagtctgttcaggctgctgtaagagaaataccataaactgggtgacttataagcaacagaaatttattgctcacagttctggaggctgcatagtctaagatcaaggtgccactagatttggtatctggcaagggcctgctgtctggttcatagatggagtcctcttgcagtgccctcacttggtggaaggggcaaacaagctccctcaggcactaattacattgatgagggctctgcctcccagatgccctacctcctaataccacaatgggggttaggttccaacatgtacattctgggagaacattcagatcatagcaggaggtgacccttacctcgtagggttactgagctatttacatagagcatttagcagtgctttgccaggctcagaatgaaataggatagctgctctcagctcatgacagcatttatgtaaatgaactggcttcagagagccaggctgaggggctgagatgacgggagggatgtagaagtggtgggaagtggattgggaggaaacctgaagaaacttggagtgggcctaggggtgcacctgctccccttctagtaggagtccttcctgcaagtggacggagggcaccatattgtgggttttttgtttttgtttttgtttttgttttttgttttttttttttttggagatggagtctccctctgtcacccaggctggagtgcagtagctcaatcttggttcactacaacctctgcctcccgggttcaagtgattttcatgcctcatctccccaagtagctggggctacaggtgtgtgtcaccacgtccccctaattttttgtatttttagtgagacagggtctcaccatgttgcccaggctggtctcgaactcctgagcacaggcagtccatccaccttggcctcctaaagtgctgggattacaggtgtgagccactcccagcctatattgtatattttaaatttgagaagaagatgggatttgaggagcagtgtatggctgatgggtgggtacaaaatggaaggccttgcccaggaaaacaatgatgggaatgaagccgaagatgctcaggaaagggagtgtgggcagcaggagggggatggatgaggagcattttctgggtgcagtcatgtgggagtagttgggttgaattcagagggtccaagagaaagggaccctgatgcaacaaacatgggcctggacagtgctgcctcagagcgggccacctgccaaccctggaaaggaggctgcgtgttcgtcaggggcaccatccacaggatcgacgcatttgttgccagagattaagagagaagtttagatcttttaattttgactgaggtggcttttccttcttttctttaaccaaggacttagactcctgaaatgttggggaaaaggttgacagggaaaacatccaccctcttcctgctgtttttcatctctatatttttctcttttgtggtggtgtggtggtgggcaataaataaaaggcatttcatttcaggggtaacctgggcagattttggaaaatgtagacagattgcaaaatcatcctatgttttcataaagtaagccctgtaatatccagtcctttattttttttttttatttagagagaggttttcactctgtcactgtcccaagtagctgggactacaggtgtgcaccaccatgcctggctaatttttgtattttttgtagagacagagtcttgctatgttgcccaggctggtctcaaactcctagactcaagtgatcctcccactttggcctcccaaaatattggaattacaggcatgagccactgtgcctggactgtaatagtcatttctaagtaattctaatcataacataaaagggtgtcttgattaaacagatactttattaagtcatctccatgagtcagtcagactgacaggttgctggttgattctgcagtaattggtgaaattcatcagtaattctcttcaagagtcactccggctctgttcattcattttatattgggaggaggtcctcatgaaattagttactgtataggtctcaacctatgcattctttcattgttgctgtggaaacaagcaataaaaatcgtgggttgaagaagaaaaataatcggtgctgaacatctgtaaaatacatgataattaacttgctttctgtaatccagaattttaaaaaaatcatcatacttggaacaaagctgagactcataaggttctgaactaattatgtaactgaatcattaatagttttccttggaaacactgtggaaaacaaattacgccgcctttaaaggagtgtttccactggtagcagcattcacagagccgctgccatcagctctgcagcgtgagctcagtcagatgcatgcctggacacacgccaccagctggtcactgtttcaatagggtcgggaactagatggtcgggaactagagagacattgtcaggagaaacaaggtcgcagactgagcaggatgctgcctgtggttcttctcgtggctggctaacgggctgtgaggggagaggcagccagggacgctagcactggccgccatcccccgggggcagttagtgagacccaccctgcccccaccctgtgcactgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggtttgaacaattttcctttcataaaatattgtagttagggcagtcactctgcccaacagtgttgggtctgaccaattaaaatatgcttcattaattttttatgatacccatttttatccaaaagaagaaaaaagtcattttgtgcttctgtgaattctttcaagtaattcatttatgtttattttaaaaataagtatattgttcctttgtcaaccctaaagccacaaagcttatgggcattttattggttgactctggctgacctgttttatctgggtgtgagatacagatacatagtgtatgggtatttggtggaatgctgtctcaggtcattctgctgaaaagtgatgtcaggacatcagtaatgtggatatgtttcagtagtttggtaaaagctgttatggagttgtaaaaattagcctagtataaagcctataaacccatcttaggaatattctatttccagccaaatcataggtgctcctactctgtgatagttcatggtgacgtggtatgtggggtgtaaagtgtgatgatgtcatgcagcaggttcaagtgatggagacatgtttttcttttctgctcttttgcaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcagggtatggatcaaaatgcacagggccaggcagagcgcctggataccctgggttgggaggattgaagagggcagtaagcaaaccagtggcctctcggggcagggaaggaggctcccaaggaggggtcgcaggaggaccagcatgcctggacatgaaggaatagagctagcgggtgggagtgggggccctctggggtccagaaaggaggtctgcaaagtgtttaacacagtaattaaggtcctctgccctgggttgcatggacatcccggcagttttgccccaagcacggccctggataggggtcgaggtcatgcacgatctttgcagccccccacaatccagttgtagttcttcaagcccctcttactggaccccgcagcagcatggacgctgttgattacgcccttcatgagggagtgcgttctcctctggttttctcctccccccatccctttggtctctaaggttgggtgggcccatgccacattcctagactcatctcttttctagctgcattcatttctttacatgagaggctctcaccgtgcaaagcctagtgcctccttagctgccctgagatgaattcatagacagtagcacctacctcatgcaatactttagaaaagtcaatatgatcttctatattagcatggatttccatctgcacagctgtgctaaaggccttgagatgctccttaaagcaccacgggcgtgacagctacaatgcagatggatttgagatgcagactgatttgaattgtgttgatgactcaactacggtgaaggctgctgcagaaggagtgacgggattgttttgaaatagcagacactcttggtgaagttctgaaccaagcatggtgccggctccctttgttttagtatttttggacttagagcagacactcttggtgaagacactcttagagctaggcaaggggcacattgtttttatgagtcaaatggagggaggctctaggctcagataataataaaaggtgttccacctgtgtcagtgcctgcggaatatgtggaaagtgtgtgggtcgtggagcagttctttgtgtaagattgtcatgagcattttaggacatctgaatttcctgtcctcctacccgttaaatattagtaacacatccagtcatggtgacaaccaaaaatgtgccctcagattttcaacacatcccctgagggacagccctgtccccattgagaaccattgttctaggtgacgggtccattctcatggcttttaacactctaagtggataacgtccaaatttgcatctccagctgggacccctctaactgcctttgtgacatcacccttggatgtccaaaagtgtaacatgtccaaaaccgaatctcaatgccttcctctccatctctctcaccatcccctaacctgctcccccaaatcttcccatttgtgtaaatagcaactccatcttcttggttgctcaggccacagccagtggcatcacccttaaaccctccttttctcatgtctcacagtccatcagtgaaatgccatcacttctaccttaaaaatatgtgtcaactccaaccaattcccactgcctcccttgtgaccagttgggtcatgcccccacccttctgtgccctagtcctggtccttggaacacctgagtcatgtcacttctctgcgtcaaccctctagtggctctccccattcactcagagtgaaaagcagagtccttgaaatggccagcgatgccctcagggcccaaccctgtcccctgcctctcaggtgtggtctcgctcctctgtgccctggctcctggagctccagccacacgttctgctggtgtttggtgacagctgtccttcggattgccaggtgcactcctgcggcagtgtgtttgtgtttgctgctccctctgcccggaaagcacctggtgcctctataggaagtgtccttgacctccatcctcctcctcctgctgccttgttttccttctctgctcttgatgccattgcacacacctgcttgtttacggtctgtcttctcatggctggaaagtaagccccctgcagacagggactgtatgcttcttttttgtactcggctctgtccctagtgcttagaagagcacctgctacctggtaggcactcagtatttattgaatgatgagcacacctgttttctggcggtctgatggaacaagaggagcttgggggcgtggggctggcctgagttggaatcctggctctgccacttccccactgtgaagctgcaggcaagctgtgtagctgccctgagcttgtgcttccttgtctttcagatgaaggtaacaccttctttgtcataaggagtaaatgtgggtaaagcatcctatgtgtaattttgtttattattctattatcctggattgaaacatcatttccattatttttgtttttattattttcaacccaacagcacactttaaacttagatttttatgtttattattattttttctatatccaataagcaacatataaacttagatttttaaatgaatacatacattccacaataacagatcattagagctgctggaatacggaaatatttttaaaagcagtgtttaaaataaggcctcggccgggcagggtggcttatgccactttgggaggctgaggtggatggatcacctgaggtcaggagttcaagaccagcctgaccaacatggtgaaatcctgtctttacccaaaaaaaaaaaaaaaaaaaaaaaaaaaattagccttagccgggcgtggtggcatagtcctgtagtcccagctacttgggaggctgagacaggagaattgcttgaacctgggaggcggaggttgcagtcagccaagagcgcaccactgcactccagcctgggtgacagagtgacactctatctcaaaaaaaaaaaaaaaaaaaaaaaaaacccacaaaatatataaaataaggccggaagaagcataggaatgtttctaaaggacaatgaatgagatgctggacacttctcccattgataggttcatgttttggaaacttgttccaaagagaaaatgtcagggaaaagcaaatacagtcattccttggtatccttgggggattggttccaggacccactgtggataccaaaatccatggatgcttaagtccctgatataaagggtgtttgcatataacctacacacatcctcccatatactttaagtgatctctagattacttatgatacctcatgcaatgtaactgccgcatacatagttgttatactgtgtcattttaaatttttttattgttgtattgttaatttttaaaattaatgttttgaataactttttctgcacttggtaccatgcgcatattaggggccttctgctctccttcccgattcctgtcctctccaggcctgattctgtgcaggaaaatgatagggcttgagggaaggagcagcagaaagaaatgtagcccgcctgacctttccagccctggttctgttcctctgatttgaccttaatctttccacctatggtatgggaagaagaaaaatactaaaaaggaagtcagagagcagaagagagaaagaggaaatggtggtggacaaaaaagcaagtaattttccctcccaatattttactgtgacaatttgtaagcacacggggaggttctacagtagtacaggggatcccacagcagacaccatagaccaccacctaggtcctacagttagcatctcactatatttgctttataggaaatggatagatagggtttcactggtcaaaacaggaacactgagacaaatccactgaaagtagaactgaatacctgactttctttttttaaattttaattcgaattattatttttttaaaattttactttaagttctgggatacatgtgcagaacatgcaggtttgttacataggtataaatgtgccatggtgctttgctgtgcctatcaaccagtcatctagattttaagccccgcatgcattaggtatttgtcctaatgttctccctccccttgccccctacccaccaacagacccgggtgtgtgatgttcccctccctgtgtccatttgttctcattgttcaactcccacttatgagtgagaacatgcagtgtctggttttctgttcctgtgttagtttgctgagaatgatggcttccagcttcatccatgtccctgcaaaggacatgaactcattcttttttatggctgcatagtattccatggtgtatatgtgacgcattttctttatccagtctatcattgatggatgtttaggttggttccaagtttttgctattgaaaatagtgctgcaataaacatacatgtgcatgtgtctttttagtggaatgatttatattccgttgggtatatacccaataatgagattgctgggtcaaatggtatttctggttctagatccttgaggaatcaccacactgtcttccacaatggttgaactaatttacactcccaccaacagtgtaaaagcattcctatttctccacagcctcaccagcatctgttgtttcctgactttttaatgatcgccattctaactggcgtgagatggtatctcattatggttttgatttgcatttctctagtgaccagtgatgatgagctttttttcatgtttgttggctgcataaatgtcttcttttgagaagtgtctaaatacctgactttcaacattggcctgaactgaaggagcagtgaaagaaagcagggtgcagaggctggggacgtggacactcagggagggtgcatacactcctgtaaatcctccttgtggtatctgagcacagcccagaaagaagagaacctgcagtgtcatttgcgaggcccaggtctattaattggggtcctcttggttgcaaatgatgaaacattggcttaagcttgcttcagcagaaaaggaatgtactgagcagatcctaaggctcccatgtcactatgagcgggacaaaggtgcattttaacaaacccttcctgtgactctgatgtctgctcaagtttgagaagcggtgtccaaccataacatgttatccaccagtaacgaccagattatgttatgtctgatgattttagggctgtgaattcttttctacatctttgtggaattgagaggaatttcttagttactttaatctgtgaggcatttgaactttttccttttatatactttcttatacaggtggttggcagcttaaatatcagtgaagctgttaatgaagatacttactaaatagcaaagcagcaccgaagtgcacaccttcataggatcttctggagcaagccagaaatctcaagtggtgctgtggccaggaaacaaagcaaaaaatgcagtggtgaatagagaaggagcaagaattagtaactgagactggtagctttccttttgatgttgcatccaaaaagcagtgacaaagtaagagtagctaccttcagctgtttgttttgaaggacacgtgggatcagttttttgtctttatgtcctacccccaggaaaccttttaagctaccagtctttttcaaatggaattcctcgtggaaggtgcaggggaaatgaagtgctccccttgaaagctttgctgctacccaaactccatgccctatgggagggaggtggcacagcactggcctgcagcacatcatacttatcctgttgtctgggaaggacaggaccacatctacccacagtgcagcataaaatcccctagtccaagaggagacagagtcagctgagtgtggctggctcacaaaatggaacacaatagctgatgtgtgttatctctagctgtgcctggtgcatcacaggcaggcacactatgcatttttactgaatattgttcttggatggatttaccgaagaagagcctgaggttcagagaggttgatgacttgcttgatgttctattgtactctctggaatccccgttgcattgcgttcatttttcctaaaaacactcccctcctccctcctcctccttgccttaatttgaatttagtttttacaggataacaatagtaaaaacaataatgatgattttcatttgttatcgttatagttggtgtctgttcaatgcatactgtgtcagacactgttatcctaagcacactgcatggctaacttgtttaatcctcagagcaacactctgaagtgggtaccatgatcatacttactttttaggtgaagaaaccaaagcacagagaggacgtgatttgcccaaggtcacacagctaagcactggcagagccaggattcagacccaggtggtctgtattttcagcccttggccactaaactgtgctgccacgtgacatagcttttttcccaacccctgtgacgtgggatggggacctcctggctcctgttggtcttcagcctggtgttgctgtggaagacacccacccctccagaatgcctccctgccctctctgcctgagaaaaactgaatcatggcctcttctgtgaggtcttgggactcccccagcccctcctgggctttctccacattcgtttctctgcagcttagtgctgtcctcagtgtgttctgtgtggttatatgggaacctcctctttaggtggttaactctgatcggcagggcctcctgattcactttgacattcatgccatatgcacagcatacagatcttctaagtggacgtaggctaaagatgtacgtccagcctctagtgggtttttggtaaagcttagctgaattacagtgttcagaatgggagggacaggaatggagaagccacaagcccgacagaagcagccctggcaaagtgacaagaagggagggaggggtttggagctgtttctcctgccgatcttcccttccctctcccacatacatgtggagggctgctgcagtctccctaggagcatggcatcccaggaggagtgcccccctctctccccaggacgtccgcatcccccgtccacttcctcctggcactgaaatctggactttatctcactgcaggattcactgaaaggctgttggatggctggaatccccttcagcctttacagctaacatactaggtgttcccatattctaagggctcttttactgtgggtgagctggctggaggagaaggggagaggagaagggggacgagaaagggagccccaccctctgctcaggacccattgttcacattcttttccgtgtgaaatgttgctgcatccaggccctaggctatgagtggtggcatttctatgtttgtggaatgaatataaagtctgttttaggatcagtggacaaaaatcagcatgtttgaagtggaggttacaatcagttggttagtacgatatttgacatttaccctgggcccttaatggtgcagtttttctgatgtaaggagggtgaaaaagcagccactatgtgtactaaacagaaggcgtgatgagtacagtcagtgcaggatcgtgaaggcatcagcacattccttcttcagctaatcagcccagacagtgtggggtatttttgtattctctgctgtttgtgctctgagtacatgtgcacaaaatgcagtgacactgatcaataaactctttaagcctaataagcatatgcagtctcatagcaatgaggacataaacagggagaaggatcttaggtgattcaaattctcttttgttggccaggcacggtggctcatgcctgtaatcccgccactttgggaggccgaggcaggtggatcacctgaggtcaggagtttgagaccagcctggccaacatggtgaaatcccgtctctactaaaaatacaaaaattagctgggtgtgggggcacgtgcctgtaatcccagcttcttgggaggctgagacaggagaatcgttcaaatctgggaggcggaggttgcagtgagccgagattgtgccactgcactccagcttgggtgaaagagtgagactgtctcaaaaaaaaaaaaaaaaaaaaaaaaaagaaaaaaaaattctcttttggaggtgaggagactgagctaccagatccaaacctttccagggctccatggctcacaggttgcccgattcctaatacagcatggtacttcatgccctccttccaaaggaggatttagattttgtttgtaaatctaaagatgcttctgttgctgccagcctggagaaccaccatggagagccactaggaaaacagctgcaatgatgatgttgaagatgatgagagcctccaacatttatgttcttaataaaatgctttaaatttttaactaagggcacaactctagagatacgccaactgctttctcttttttttttcggtgggggggcgggagacagggttttgctctgttgcccatactggagtgcagtggtgcaatcatggctccctgcagcctcgaactccagcgatcctcccgcctcagcctcctgagtagctaggactacaggcacgcagtgccacaccccactaatttttaaaaaagattatttgtagaaatggagtcttactatgttgctcaggctggtcttggactcctgacctcaagtgattgtcttgccttggccttcaaatgttttctccattttagaattgaggaactgcagcatcagtacctgggtcatataggtaggaagaaggagcgctgctcccttcaccactccctgggctgcctccttcctgtgtgattgcagggaacctcctatatagagatcccagatcccaagtcttcttttgcatgtcccactccctccccacccttgaaaacaaaaacaaaccctgcgatgcagcacttactgctgactcctcaccagagaccccccagccctgagcatggtgctgcagctacctgtgctttccccccggtcactgctactgcttcacccctgttcttatcatgactggcgccacctatgttaccatgccaggtcctcttgcagtgcctcaaaggcaaaactcccactgcttgcgcactgctgtcttgtgttgcctccagctgtcatctcaccaagaccttgagtcccaggaaccaaccccttatggaagggggcagggcaagctctacctctgctgctctggggtggtggctggggatggaggctgtggtgggatctccgagggggtttcacttctgttcccagtaggagtgctctcatttgttggatttcctggtttattctgggtttcagagagcccttcctctcttggcctttgctgtagagtttgaaaattctgtactttgagtcagacttgcagattttagaaatgtcagagaatcagataggggaaaagcagaatccaccgtgtatggcttgcgttattgcgttaagaattcccttaaccactgtgatttccctttttcatttgagaagtcatctagggagttttcaaagtttcaaaccagaattgattttcatttggggaccagggaggcacctgagtgtgcttcttggaagagtgagtaatagtttttctctattgagaaaaagctgccaacattatagactatggtcatttaatattaaacatgtattatacaggtgacctgatggatggtttgagaggttggagagcttgagtgaagggatgctttttactctgagatgggaagtggaaagaccattacagagttctctaagaagggtagtagtgtaacttctggattaactcaagtgtcatgtttggtccatgatatggtttggctgtgtccccaaccaaaattcatgttgaattttagctcccataatccccacatgtcacaggagggatctggtgggaggtaattgaatcctgctgttctcatgatagtgaataagtctcaggaggtctgatggttttataaaggggagttcccctgcacatgctctctcttgcctaccaagagtatagtgagatgtgactttgctcctcctttgctttccaccatgattgtgaggcctccctagccatgtggaactgtgagtcaactaaacctctttcctttgtaaattacccagtcttgggtatgtctttattagcagcatgagaacagactaatacagtccagttgctaaattaggggactgtgctgttgttcagaaaatgtggtcgtgggccaggcgtggtggcccacgcctgtaatcctagcactttgggaggctgaggcaggtggatcacccgagatcaggagtttgagaccagcctgggcaacatgatgaaaccccgtctctactaaaaatacaaaaatcagccaggtgtggaggcacacgcctgtagccccaactactacttgggaggatgagaatcaggaaggcagaggttgcagtgagccgagatcgcatcacggcactccagcctgggcgacagagtgagactcgtgtctcaaaaaaaaaaaaaaaaaaaaaaaaagaaaagaaaaacaaaagaaaatgtgattatgctgacatctagtaactggagttgcacacaaatcatccttttaatgtgaattacttgtttttaaagttaataatttgttttgaaatcttgaccaagattgcatggctaatatgaagacatccaccatcaggctgggagtggtggctcataccgataataccagcatttgggaggctgaggtggaggattgcttgaggccaggagttcaagaccagcctgggcaacatagtgagatcctgtctcttcttttcttttcttttttcttttttttttttttttgagatggatagactgtttgccagtatagagtgcagtggcgcgatctcggctcactgtaacctccatctcctgggttcaagcgattctcctgcctcagcctcccgagtagctgggattacaggcatgtgtcaccacacctggctaatttttgtattcttagcagagatggggtttcaccatgttgaccaggctcatctcgaactcacctggctaatttttgtatttttagtagagatggggtttcaccatgttgacaaggcttgtctcaaactcctgacctcaggtgatctgcccgttttggcctcccaaagtgctaggattataggcatgagccactgcgctcgaccatgtgatcccacctctacaaaaatatttttaaaaaattagccaggcatagtgttgtgcacctatagtcctagctacttgggaggctgaggcaggaaagcccaggaattcaaggctgcaatgagccatgtttgaactactacactcctgcctgtgtaacagagcaagaccttgtctctaaaaaaacaaaaagacttctaccgtcatccctcttgttaaaaggcaatggcgagttactgtttaatgagtagactttatttgtgatggtaaaaatttctggagatggatggtggtgatggttgtacaacatggtgaatgtatttaataccactgaattgtgcacttaaaatggtgaattttatattatgcttattttagcacagtaaagttttaaaaattacaaaaaaaaggaaaaaaaaaaaacccagaaggctagtatttgcaggagtggaactaggactttgcctaaattgcaaacttccttcactccaattttctttttctgttttaatgaagcacagcatatttacaataaaatccataaagtacactaatcttaatcttagctataaagctcattgcatgtttatatttttttacacttgtgtaaccaccaccctgtcaatatgttgaacgttccagcaccccagaaggtttctttttggttgtaactccccgagaggtaaccactattctgacttatattaccatcatttgattgtgcagcttttaaacttaatacaagtggaatcaggcagtatatactcttttgtgtctgcttctttcacttagcataatacctgggacagccacccatttattagtatatcagtaattcatttttttcctatttgctgtgtggttctcattgcatttatcctctctgttgaaggacatttgggttgttctagttttgggctgctataaaaaaggtgctatgaacattcttttgagggacctatgtacttgcttctcttgggtgcggatctaggaatgggattgctgagtcacagggaactgtgcgtgctcacttaggagtctcccttcttcgacttactgcctttcagcaaatgtttgtcctacccctttcatgacagggaagaaagcaaagcaagagcagagggtgttgctttcttctattttccagccttagcgttagtagatactgccactttccaaagcagttatgccagtttacacttccactcacagggcatgagtgttccagttgcttcacagcctcaccaacacttggtattggtgtttattcactttcaaactatggtggggtgagggtggttacaccctgaaatttaaatgatgcaaagatggaaactttaaaaaattgtgcaaatatttaaacttctaactctcagtaaatgaccccaaagccagtggagtaggatggagcagggcttttcccttcagcctgtgtgatgggcggggctcgcccactgcatatcgacattgatttaagggcttttccttactgtgtgctctggatgtcagatacattagacagctttgggcagctgccttctccagtcttccggcactgttcctctccagagccttctttcatgaagacccaacagtagttgagagaattcagttgtggtttttctcattaacgttgaatgtaatctatctgggcctgaagtgtggatcacttaggagtctcctttcttagacttcagcaccttttagcaaatgtttgtcccatgacagggaagaaagcaaagccagaacagagggcgctgctttcttctgtcttccagcctccaagatttcctttctcacctttgaacacattttctgtgtcagatcatctacagaatgcttggtggtgaggccacagcagatactcagattgtttctctccctccacctcctcctggcctatgtcatgagcctttttttgttgtcctggaatttcttttgcattgccctaccctgccttttgtgcatctcccagttcttttttcattggttcccattctttttttcccccaccaggagagcagatttattttttatttaaaatttttgtttagagacgaggtttcactttgtcacccaggctggagtacaatggcacaatcatagcttactgcaaccttgaacttctgggctcaagcaatcctctcacctcagcctcctgggtgtcaccatgcccagctaattaaaaaaaaatattagcgagacagagtctcactgttgcccaggctggtcttgaactcctgagcccagcagtcctcccacctcagcctcccaaagttctgggactacagtcgtgagtcactgtgcccagccacattttttaaggctcattacttgaagtgtgacctgatggtattcttcacgcacagtcttagacactgctctttgaaacagtcatgggagatcatactcggacctgttatgacagaaacaggtttgtgtagctttgcattttttcacttcactctatcatgctactcaaagtgctgttattgtatcttgactgctgggcacatagcccagctcccatgctctgcttgtttatagcgctccttcctgaaaaccacctcttcatcctctctctttccttccaactctctcagctcaagagggccagcagtgaggacacgctcaacaagccaggaagtaccgctgcatcgggggtggttcgcctgaagaagaccgccactgccggagccatctcggagctcacggagagccgcctgaggagcggcacaggtaggagggaccgggcaggtgggctcggcaggccatcagtcctggccgcatggaagcacttcagtgacccatgacccatccattccttccctcgtgaaatatttcttgaccacttaccctgggccggaactgttttaggcagacgatgtcgctgcccacagggagtttacatctatagagtggggagaccgatgagaagcaaaaggtaactgggcgtgctgtggtttctttggtcccttcggaggtccatttgtcaccatgcacgtgtgaaatccttctgacatccaagcagggcggcatatgttctggggctgtcttgatacagaatgcattagaggaatgaatgaaccctgttgatcccttgcgaaggtgggtgtctaatatttgtactgaaccctatggaaagctgggaagagcctcgcccagcagctgtggaaggctgctcagagtggcttggacggcagtggcaacaggaagctgtgaaccttctcagtgttactcattttttaagaatcagaaaagggtttttcaatcattatatttgagttcagagcatgtgaaacatgaaatatcaaagaatttatttaattctctctttgtgcatatagataataactcttaagctttcatggcctaactcttacagtgcagccctcagtgtattgctaaattgtctaagacgggaaaaataactgaaatacatcgttactaatttttaatgtgttgaaggggcacttataatttttgtgctcttttcgtaaaagtcacattcaggctagatctcaaaaggtatattttaatttatcagtttttaaaaagttgaatctgtgaaaaccatacaaggtattcttttcttggatataaagggaatggcctggtttttctatataatggctttaccattgtaaatactgatattgtattaaacatacacacacacttggtttttaaaatacaataaacaaaagtaccatttatttttatcaagccagcctaacagtgatcccaaaagttaataaagccccactcaaaaaaagacagactgggaggagcctaggggcagggtgggaatgaggaccagccgagtcccgggtgtgggacaaattgcgtgtgtgtggtgtgtccccaaaagcaggaaggtggcgaaaggaggcgaatcccagtgggtggagggaggggaaaggcggaaggagaaaaaggtgggaggaggatcgggtgggagggtggtggctcactcaggacccagggggggggcagcgcgatgaggtgggtggccctgttcctgaacggcagccccaagaagggaaaggtggttgctgtatgtggaactttatctgatttgctttctgtggccagtggtaaacttggcataaaagccaccagtgtgtataatggcaaaggtggactgattgatgatattgctttgatcagggatgatgatgttttgtttgtgtgtgaaggagagccatttattgatcctgacagattctaaaccacctgagggattgtcaggattccacatagactggctaacattaaatgctggaggggcggtactttacaaccacacagagcactttagtgaataaagaacctgatagtatgctggcccacatgtttaaggacaaagatgtctgggaaataagcaagatcacagaggagctttcttaattgaccgaagtcctgagtactttgaacccattttgaactacttgtgtcatggagagcttattgtacatgatggcattaatttattggatatgttagaagaagcaagattttttgtattgactcattgattgaacacctagaaatggcaataaagaattctaaaccaccggaggatcattcaccaatatcctgaaaggaatttgtctgatttttgctggcaacttcaatcaagtcagaactgcgatgccaaggtttgaacttcagtggtgctgatctttctcatttggacctttgaaacattaacttcaaaatggccagtttaagccgctgcagtcttgcacatgcaaatctttgctgtgcaaatcttaaacaagctgatctctctggatcagtgcttgactgtgcaaatcttcagggagtcaagacactctgttctaatgtagaaggagcatccctgaaactgtgtaattttgaggatccttccggtcttaaagccaatttagaaggtgctaacctgaaaggtgtggatatggaaggaagtcagataacaggaattaacctgagagtgactaccttaaaaaatgcaaagttgaagaactgtaacctcagaggagcaactctggcaggaactgatttagagaattgtgatctgtctgggtgtgatcttcaagaagccaacctgagagggtccaacatgaagggagctagatttgaagagatgctaacaccactacacatgtcacaaagtgttagatgagaattttaggggctggaggaacatgtacaagatgaaaatgttttccttatcacttttctttctccacccgctcagttgtctagaagaaataacactgtaaggaagttaaaaaaaaatttagaggattatgcttgttctcagtggtgcataagggaaaaaattgacttttttttccatattctgatttttaacagaaaagcactcatttaatagatatagggaaactagatattgctgccttttgaacagggtaggggggtttacctggttttatgaccaggaatagtatctattacatttgcttttaaataggcatgatgtggaaataccatcttggtttgagatgcatttgaggattttaatttatggaaagcacaacatatgcaatttatatttattgaatactagatgcagtatggatatttaaattgtaaaaactttacgaaaacttggaaaaggttgttcaggtttataaatagctttagtgatgcctccttctttaaatacttgtcacagcatatgaatatggtaagatcagactccctaagactcttcaggttcatttttataatgtttactttttagaacaaaacagtagctaaattacagtaatatccagttcttactgattgagacagagtggaaagaaagacatcgttgtacatcactgtcattccaaaggtacagtggaactccggatggaggaagaacttacctatcactacaacacttataaatgagcatttctcagaatgtcattctaggcaagttccactcaacaccagaccaagcaattctgtctattcacactattagcctagttttctcatacaatcagcacaagcataggaagatacttcaaaaccaaaaaaccaaggtgcaccattaatattcatttaattcaaataccaaatagttttacatagggccatcttagaaatagatattaaatccagatctactgcaatcaaagcttacacaatatgaatgaatatggtagagttgcctgttaaaaggcaatgtaatataattgctgctagaaccctacagtggggaatgaggaattttaaacatatatttgattacagccaccaaaaaagtatatataaagaaagtaaaaataaaggcatttggctggtccaagatgtaacaccaatcagtcagcacctatgattcttttacttacattttttactttttgtttttgtttttgtttttttgagacagagtatcagtctgtcgccaggctggagtgcagtggcgcaatcttggctcactgcaacctccgcctcctgggttcaagcgattctcctgcctcagcctctcgagtagctgggactacaggtgcacaccaccacgcccagctaatttttgtatttttagtagagacagggtttcaccatgttagccaggatggtcttgatctactgaccttgtgatccacctgccttagcctcccaaagtgctgagattacaggcgtgagtcatggcgcccagcctgtttttttttttgtttttttttttagtgaaatttagcctgtttttcttgagtcattttctctctgcaacagtagaggaagggcctgtatctccctaccaatgacctggtgtccttacatctaccccaagagcagggatgttagctgtgtccacagggttctgaattctacagactcatcaacatgaggcaaggaatcattgaaaaccacttttgtctcctttgggagaatgactcatctttagtatttatgtagtgtattcttctatatctacatatgcaaagctttctttgacagtaaagggcacatatgcatagtgggagaagatcagacctttacaagtgaaggaaagcaacttcagaaatgaattattttctttgctttattatttttaccaagacagagaagtattgtattgagagattatctattttcataatcaacatttgcctaaattatatttaaatcatttcactttgtactatattttcaggaattatagaatgtgttattcactcacttaaaggtacctctgtagaaataacctaaaactgcagaaggatccgaaagatataacatggtgtgtttagaaactgcagattttagatctaatgtatactgcattaataaatgatgtaaagtgtggaaaaggaaaaaaaaagactgatcccatgatcaaatattaatataaaaatttgagatcagccgggcacggtggctcacacctgtaatcccagcactttgggaggccaaggtgggtggatcatgaggtcaggagatcaagactagcctggccaacatggtgaaaacccatctctactaaaaatacaaacattagctgggcgcggtggcgggtgcctgtaatcccagctactcaggaggctgaggcaggagaatcacttgaacccgggaggtggaggttgcagtgagccgagatcgtgcaactacactccagcctgagtgacaaagcaagactgtctcaaataaataaataaataaataaataaaaataaaaaaaattggagatcaaaatattagtgcataggattcaacaataaattaaaagaacagtagtgtacatcacaactaagtgaatttatgccacccaagaatggatgaatattaagaaattttggaatataatctatcataccatattaacaggccaaagaagaaaaactgtagttatctctatagatacagaacatacatgtgacacaattaacaatctttctaacaacaaactcttgatagactatacatgtgcagagacttctttaatgatgtgtatgtgtcacaaacaaaagccagcgattcccattaaagtcaaagataattcaaggttgcttactatcaccagtcatctaaaattttcggtagatactaaccaaggcagtaagataagagagatgtagaagtacataaatattggaaatgagggaacaaaatgatgattgtaatcagataataacattgtatgctttgaatttcctgaaaattgtcttagaattttctgaaattctattagagacaataagagttctgtatgtggctagttgtagactataatatatcaataactttcttttttatttattttatttatttatttttttgagatggagtctcggtctgtcgcccaggctggagtgcagtggcgcgatcttggctcacggcaagctccgcctcccagtttcacgccattctcctgcctcagcctcccgagtagcttgggactacaggtgcccgccaccacgcccagctaattttttgtatttttagtagagatggggtttcaccatgttagccaggatggtctcgatctcctgacctcgtgatccacccaccttggcctcccaaagtgctggaattacaggcatgagccaccatgaccggccatcagtagctttcttaccagtgactagaaaagataataatgtaagaaacagttctatttataaaggaatgaaagggcaaaatatttagaaatagtgtgagcatctataaaaaaaatcttaaaactcttttgaaggagaagtcttatgtccttcaaagaagacataaataagtgaaagcatatatgtgattcttaggaagattaaatagaattaagattaaacttagtacaagatataaaatgtaataaggatgtctgaattattctaagaattccttttcatcttgattcagtgggaatttgggagtggaaacctgaataaaataactggaatttatctaaaacccgttgttctcaatgggggacgattttgtcccccagttccaacccagggaacaattggcagtgtctggagacttttttttttttttttttttttttttttttggctgtcatgactcggggctgctactgccatctagtgggtagaagccagagatactaaacatcctaggatgcgcaggaccgtccctgcagtggagagtgtcctgcccaaaaatgtcaacagtactgctgctgagaaatcctgacctagcagaataaatattctagagtaaccaggaaaattctgacaatactaatcaggggattaaccttaggcattctggaactgaagaggtgctaggcagctcagtggaacggtggacaaagtgcagaatacactggaagatttagtacaggggaaaggtggcatttcatatcacggtggataattcactcaaaaatgtgaccgagtaagtatttaggaaggaataaagctggatccctatctcattcctcccatcaaaataaattctaggaggattaaagatttaaatattaaaaaatgaaactgcaagactacaaagagaaagcatcagagaattaatttgtagtcttggccttggaagaacctttctaagtaggaacagacacagaagccataaaggaaaagatgaaaaatgtacttacataaatataagaaacttctttgcaaaaagaagaaattatttgcaatacatgtaacaaaatgcttatttacaaagagtttatacaaatcaataagaaaaagaaaaataggccagatgtggtggctcatgcctataatcccagcaatttgggaggccaaagtgggaggattgcttgagcccaggagttgaagaccagcctgggcaacatagtgagacctcatctctacaaaaataaataaataaaaattagctgggtgcgtgcctgtagtcccagctgcttgggaggctgaggtgggatgattgtctcaaaaaaaaaaaaaaaaaagaaaaggaaaaataatataatagaaatatatatagcgcccatgaaaaatacagatggctagtggaaagatactaagccttacttaagaaatgtaaagcaaggctgggtgcggtggctcaacgcctgtaatcctagcaccttgggaagctgaggcgggctgattgcttgagcccaggagttcgagaccaatctgggcaaaatggtgaaaccctgtctgtacaaaaaatacaaaaattagccaagcatggaagcgtgcacctgtagtcccagctagttgggagacagaggtgggaggatcacttgaacctgggaagtgaaggttgcagtgaactgaaatcatgccactgcactccggcctgggcaacagtgagaccctgtctcacaataaataaataataaataaataaataaataaagcaaaacaacaattagatatataatttccgctaatacattagcaaaaattaaaacagtttatcatttctggtgtcattaagggtgtaaagagccacatatggttgatgcacaaggacaagttggtaatatctatctaaatcttaatttaatctttcaccaagcatttctattatttagcacttaacggttactgatattcttggaaaaggatgccaacatgtatgagcaagttcagttgcatgattatttataatagtataatatgggaaacaacctaagtatgtattcatacagggctggttgaacaatgtgattttggtgcagtagaatagtatacaggcatgaaaatgaatacagtagatttgtgtgtactgatagggaaagatttccaatatacattactaagtggggaaaataatatggtgcatatggtataaccttaatttggttttggttttagaagtatatattaattattaaaatcaacttttttttcctggaaggatgtcagaatgattatctttgaggagagttagcagaattgatagtggcagaggaaaattttttcattttagattttcctgtgctgtttgaacattttaaacatatgcatacattgctatacaaaattaaaaacaaggtaaatacaacataaatttagacaatataaatataaactaaacttttttttgccttcacaaaatccttcctcttctacttgccttttgtagtgttctttagccatttgttggtggatttttttttattgtttgcttatagcatctgctcctttgcacaggattctaggaaaagaccttggtttcatattggctcctaaagtagacaagttcccatgccccaaggggcattggcatcctttatttgtcaaaggaaggaaataactacatatctactatacagtgatgttgggaaaaaggtctgtgaataatttatatagactgtaatgaaaagtaagtgacagttattattctcctagttatacaaattgtttgtcagttacttcatttaagtgaaattaaattatttgagttaatagggttgaatttgaaaattacattttgtttctgaagcttttatttttttaaatttattttattttttgagacggagtttcgctcttgttgcccaggctggagtgccatggcgctccacaacctccgcctcctgagttcaagtgattctcctgcctcagcctcctgagtagctgggattacaggcttgcgccaccacgcccagctaatgttgtacttttagttgagatcgggtttctccatgttggtcaggctggtcttgaactcccaacctcaggtgatccacctgcctcagcctcccaaagtgctgggattacaggcgtgagccaccacacccagccaagagcttttatttttaaatgtcagtagtcctcaacatttttgtagcacctttggacagctgatacttttgtacattgtcatgctgtccccagactgcctcatttggaataggtgaataccagtctattaggacagaccattaggagcagtggtatgcagtgcctgtctgttgcaggtgttatcacctctacagttgtatagtattgtttcggtaatcatttcaatatttgattgcattttgtctattttacatgcgtgaaaacgaggaaaatgaaagtgctggttgggattacagcaactagttgtacaggctgaacatcccaaatccaaaaattcaaaatcccaaatgcttcaaaatctgaaatgttttgagcactgacatgatgctcaaaggaaatgctcactggggcattttggattttggatttttggattagagatgctgaactggtaagtataatgcaaatattccaaaataaaaaatcagaaatccagaacacttatggtcctgagcattttggataagggatactcaccctgtagtaataagcttgggttttaaaatctcagtactgccgggtggggtggcttatgcctgtaatcccagcactctgggaggccgaggcaggcggatcacctgagatatttggagaccagcctggccaacatggcgaaaccccttctttactaaaaatagaaaaaaattagccaagtgttgtggcgggtgcctgtaatcccagctacttgggaggctgaggcagaagaatctcttgaacctgggaggtggaggctgcagtgagccgagattgtgccactgcactcgagcctgggcaacacagtgagactcagtctcaaaaaaaaaatacagttgatacaaagatggaaattatttagtgtgttagaaattagatgttcactggacttaaaccaattttctataggctcagctgtgaaggaaaagaataaaattaaaggaaattgggggacttctggcaatatatagttgatttcctttcagaggaaatttcttttcacaggaaatcaactatatattagacttgtagggggcagaattctttttatgccatgcaagacttagtttttgtacttttgacttggggacaagttttctacgatgcatagcatggtattatctatattttatttcaattgtattaattttgagaaagatttttgtcatgaaattttaatacagtgttgtgattttgaacttacaagaattaaatctatagtcagcctatattttattgcaccctttcctgggagctgatctgtcctcagggagaatccctgaaatctactccaggagaaatcatgtaatcttttggtcgtaataattatattattgtctcagccttgcctagggcgccaacttgccatctgtcatgggtggtattggaactgcttgaatggggaggcatgagcttcctcattcttttcaagactatttccagtttctggtttccaggccttatgctgttctctggggctatgccaaagtttgctccaacaatagcaagaacacagcaaaaatcacaaaaggggcttctatttttgagccctgccacctgcctgcactgtgccggcttctctgagctgctgtctctattcatgctcacaatagccataggaagagcatggttattttatctagaccaggaaccttggctttggaaaggtcaaaccagttttactttttctctcccgtgcccaccacaggtttccatatggaacatccactttttctaattggttttatttcattaatattattcacttatctgaattccaaaaaagaattctgaattcttttttttgttgttgttgttttttctatagacggagttttgctctgttgtccaggctggagtgcagtggtgcaatcatagctcattgcagcctccaacttctgggctcaagcaatcctcctgccccagctctcgagtagctgggactacaggtgcacaccaccggggtctcgccatgttgcccaggctggtcttgaactcctgggctcctcctgccttggcctcccaaagtgctgggattacagacatgagccactgcgcctggcctggattccagttcttattattctttttctccctgaggtgtcctttgtgtgtatctcatgttacacagtggtgtggcttttagagaatgaggaggttccttgtgtgcagggtcctccctgcctgccccagggtcaagtgaaaggttgtggaacccccagaaggctgtcaaggaatccagccactaggtggcagccttgtcaaaagcacccaccttctcctctgctacaagttctggttctgacaaatgtttctgactttagaaacaatgcttgtatttattgattaattcaacaaatatctttgagtggctaccatgtgcctggcactgttctaggcaaaaggactatatgagtgagcaggacaaacatccctgccttcataaaggtacatgagcaagacgtgggagagatgagaaagccaggtgaacagctggagtggtggacattccaggcagagatgacggctggcccgtgtcccccacgtcaagggagtggcaggaagaccagtggggccgcagcagagtgaacaagcagttggggaggaggatagaaagatgggggagcttgcgagtcactgtcaggactttggattttttactcttgactccactggggaacttttgcaaggttttgcacagagcagtgatatgacccaacctcattttaaaaggactgctttgggctgcttgttgagagtggacagatggggtaagcagaccagcttggaggctagggctgtggtctaggaaagaagtgacctgggctgggctggcagccatggcaccggggaacagcagctgcgtctggatatattctgaaggggagagccagctggctctcaactttcctggtttttgaattgtggaaaaatacacataatcatttttaagtgtacagttcagcggcattaagttcattcacattgttgtacaaccatcaccaccttccatttccagaactgtttcatcttctcaaagtgaaactctgtccccattaaacactcgcttcccattccccttccctcagctcccggcaagcaccattctgttctttgtctctgaatctgactgctctcagttcctcataggagtggcatcacacagtgtttgtccttttgcaaccggcttatttcactcagcataatatcctcaaggtacatccacactgtagcatgtgtcagaatttccttcgtttttgaggctaaataatatttccttgtctggatataccgtatcttctttatccattcacctgttgaaggacccttggcctatttctaccttttggctattgtgaataatgctgctctgtacacaggtgtacagatatctccttgagacactgctttgactttttgagggtatatacctggaagtgggattgctggattctcctgatggattgtaaagttggtgtagggtaagatttctgctcatgttagcagtgggatgagtgagatgaaatctgatgggccttcccaagggatgaggagtgaacgtggatctcttctggagacagcagtcggctagaaggaggttcatgtagccacatttaaaacatttttaaaaccacgagacatggaagtgcccatttagatgtttctttatatagcacacgtgggatccaaagacatgtcactattttaaactgatatcagtgttttctaaaaggcaaaataaatgtgaagggctagttttactgtggccaaactctgatgcttgcagaatctcagacatctcagatggtgatcagtaagggcaagcagtcgtgattggctcactgccaagaaactgtcagtgtcctcgctgatacctggacccctgcatgctcccagttacctgcatcacaaccaggtaatgcctgaggctccaacctgagacacctgtcctctctgacatgaggagggaataactctgtcctctctgacatgaggaggggaactcgtctaacatggaaggtaagtattcttatccccatctgacatgtgaagaagcgaaagctccaggataggtagtgttcccaaattcaaacccaggtccgactccagagttcttttttctgctactctgtttgtctcaggtagggagacttgttttcttccctcatcatctttacctgttgtagaattactattaccggtgactagcattctttgctcactatgtgctaaccactgttctcagtgtgcgatgaatatggtctcctttagtctttactacagccctatgaaatagtatccttattatcattcccattttatagatcaggagactgaggcataaagagattaagcagactgtccaagtccatgggatataaatattggtaccaggacttgcagattaggaaacaggggctgaaagaaaaccatggatgggttggcttgctggggtgagagtggaggaaggggatgttggaagttttggagttgagaggccggaaggtgggtgggtcagtttcttggatgccacagaaggaggagggccatgagccagggatgtcagggaatggggagaatggggtggggatgtgtagatggcaacagggaggggaagaggatgccaggtcctgctgtgtgaactgcagaaatggaaggtgtctgtttacagtggggaggggaacagacggggggaagcaacagtcataggtatgaggtacagcgagaccttcagtttgggaaatgtgagaaaatgaacagactggccttgggaaggcagtggtgggattcatccagctgtggaagtgaggggacattcagagagctcagcctatgggaaatgttgatttcactgtgagttctgaagggccctgaagaagtgttggggactcaagggaggggcctggggcaggtggggctgaatcgctttggagatgagaacctggaaaatcacagaatgccaggaatgagtttgttcttgttttcataattttagagaggtcatttatcaatgagtatattttgtgataaaaaaaatttcagattcggtatagatgctcctccacttacttcatcggttacttccagataaactcatcataagctgcaaatatgctaagttgaaaacacatttaatgcacttaaccttccgaacatcatagctgagcccagcctgctttaaacaggctcagaacactcatatgagcctacatttgggcaaaatcatctaacacagagcctattttataataaagtgttgaatatcttacataatttattgtattagattggtgcaaaaaagtaattgtgatttttgccattttaaaaattgcaggccaggcgcggtggctcatgcctgtaatcccagcactttgggaggccgaggtgggcggatcacgaggtcaggagatggagaccatcctgactaacacggtaaaaccccgtctctactaaaaatacaaaaaatcagccaggcatggtggtgggcgcctgtagttccagctactcgggaggctgaggcaggagaatggcgtgaacccgggaggcggagcttgcagtgagccgagatcgcgccactgcactccagcctgggcgacagagcgagactccatctcaaaaaacaaaaacaaaaacaaaacaaaacaaaaaaattgcagttacttttccatcaacctaatttactggaagtgaaaagcagaatggttgtctgggcacttgaagtacagcttctactgaatgcgcgtcatgtttgcatcaccttaaggtcaaaaagggtaagtcacaccatcataagttcggaactgtctgtattttcattttcttctattttattctacatttaattcattttcacattgtggtaggagatctaccctctgaacacatttttaagcatgtaattcaggggcaatgctgcatagcaggtccctcaagcttacgcatctgtacccactgaacgactccctgtcgcactgtctgcagcccttggcagccaccactcaactttctgtttctgtgagtttgactgtttgagattctgcatccaagtgagatcatacagtatccttttgggactggcttatttcccttagcatagtatccttcaggttcatccacaatgggacatgtgtcagagtttccttccttttaaaggctgaataatattcgatcgtctggatagccacactttgtttatccatcatacatggatggaccagactggctttcagcttctggtggtgtctgaggtaaacccagttgtgaggatgttatgaactctgcactagttaaggtgctgaattctaagcttgaggacacacatggtggtgtcgtggccctgcgtttcccgggagtacatgatttagtcagggctttggagtggggccaagggttttctgtgactttctctgttggcacaaggtgcagtgctggtttggggatggcagctctcctgggtcctccctgggtgcctgtggtatagacagtggggagctctccctgcacctccccgaagaatactgacatctttgccaactctttccatccaggtcctggctgtctctccagttctccatgtcctctcttccttttatttgggctcttcccctgaagtttgctatttcctttctccctccttccctgctctcctctcctcctttcctttttgttgagtttatacctttgtttatgccttccctcccttcctctcttcttctctcccttcattccttccttcctttttgttgagtttatgcctttgttttatacttttattcctattgtgaatgggattctttattcattgtactttgttcttattttctaacatatggactatttcacgactttgaatgtcatccttacacaggaaccatgctaatcttctctgcatcattccagttttggtattagcactgtcactgactatattttctaattagatactttaaaaaatatttagtttggaactggctcgctcccttaccatcctctcttcttagcactaatggttttcagttgattctcaggtgtcttccaagcagacagtcatatcagctgcagataacaatgccttttgtctcctccattccaggagttattcttttatttctggttcttgctgttttgtgcatgtgtgaccccagttgtgttaaatgctagtgacatcttgacttgctctcactttactgtgggtgattttggtgttttctgattaaatatgatgcagaaagttggcttggggctttgttttacatgttaagtcttctcctcctatattcctttgagttattaggatttggtcatggcttttattaaatgccttctaggcatgctgttattactttgattattgcttctctttttaccctggagtctcctccaggaaattaaagtatgtgtgtatttggtctcctgggtatttcttccatgtcacatatgttatctctgattcttgtgatcactttcattcatgctctgatttttcaaagtttatcatctaatgtgctttgctttgtatgtttcttttcttcaactattatgtttttaatctttagtctgatttctgtgctttcaaattatttcttcatgacttcttgctcaactttcatagctatcaaatcttgaatttcaaatgagaatgcaaattgcagatttttttgaaatctcccatttctaccagtaactttgtttcataggtgcatatttacttggaatcctcagctgctcccccttttatgatctgccagagctttccagatagatctagagagttttctgtgatcacctatctttacagagggaagctagtattggtccaaaaatcagaaattgagagggatactactggagaatgtgtggttatcaggtcatctttttttttttttttttttttttgagacagactctcactcttttgcccaggctgaagtgtagtggcgtgaccatagctcactgtagcctggagctcctgggctccagcagtcctcttgcctcaggctctcaaagtgatgggattataggcgtaagccacagcgcccagccaggtcatatcatttacgctctgtcgaaggaagaggaaaaatttttgcattatctggggtgaaagtaaggagggcattaaagcctgaagtgcaattttgccatttttttcttttctatgtattttgtttttgttgttctcattgttactttagtgcctgttggaaggtggccttgtcctccccttctgcttgcatgatggcccctgttcttatcagctggccatggctgtttcccttgtgtggccttctgtgcatgcaggcaaggagaagggaacactagcaggccttctgaagctgctcatggcagaggcctcaacttagtagtccagttacccttttaaatgatgacgattctgtaatgtgccctttaatatcctaaaatgaaattcaccagtccatatacattactgaaaaaaatcaatataatgctgtacctataatgtagagaagaaataaaaggcaaataatttctaatgaagtgacatatcagtgtgtaagtgctggagcctgactccactagaagacagatgcttgtacattagtggagattgctgccttaagcttgaatgctacaaatgagactgactcatgggtgcagtgttgagaattcaaataccaggcgtgttgacatcagtgactttgaaatgttgacagctcagggtaaacattttgaataaagcaaagtactgtctttccttaagttacatgatagttgcattcctagaaaattcagtgtataatagcaatgctgtgtgaaactgctttgtgtttctctgtaaaacagagttagattctggatgtaggtatttataactgtgttctcctattcaggagtgctgtcagatcacaaggagggagcaggaagcaggaagcaggcgtgcccctcatatttgcaaggcttggggcaagagtgcagcgggggccatctgtttattcacaatattctgatataattaaatattctagtaaaggagatcaagtgtcagggatttcagatgacctggtagcttgtcgatctaatgacaataattttcttactcattttcatcttttttttaatcagtaatgggtgaattttgtgtggtgaattttattttttcttcccagcttcccccaagttctactttagtattttctcatttttatcactttgaaatttgtaattcttctcaaaggttaaaaaaattaatgatattcaaatataattttaaaataatttttcttcaaaatagaaattaaagtcaatataaagggtgaaatatatttcatatttttaaattttttaatttaattttttatttttagagacagcgtcacactctgtaacacaggctggagtgcaatggcatgatcatggctcagtgcagcctcaaactcctggcctcaaacgatcctcctgcctcagcctccaaagttgctgggactacagccatgcgccaccatgcctggttaattttttaaatttttttgtagagacaggtgctcactatgttcctgggctgaagccatccttccatcctggcctcccaaagtgctgagattatgggtgtgagccactgtgcctggcctgttttgtttttttttgttttttttttttgagacggagtctcactctatcaccaggctggagtgcagtggcaccatctcggctcactgcaagctccgcctcccgggttcaagccattctcctgcctcagcctcccgagtagctggggactacaggcgcctgccaccacgcccagctaatttttttgtatttttagtagagacggggttttaccccgtgttagccaggatggtctcaatctcctgacctcgtgatctacgcacctcggcctcccaaagtgctgggattacaggtgtgagccaccgcgcccagccagatttcttttttttttagctgttgaattttgtgagttctttatatgtactagaaactagttctttattggatatgtggtctgcaaatatgttcttccagtctctcttttatcttttcaaccttataacagggtctttcacagaccaaaaattttaaattttgatgaagtccaacttgctaattttcccttctatagattgtgcttttgatgtcaaaattctttgcctagagccagttttgttgttgttgttgttgttgttttgtttgtttgtttggttgttttgagacagagtctaactctgttgcccaggctggagtgcaatggcacaatcttggctcactgcaacctctgcctcctgggctcaagtgattctcctgcctcagcctcccaagaagctgggattataggcttgtgccactgcgcccagctaatttttgtatttttagtagaaactgggtttcactatgttgctcaggctggttttgaactcctgacctcaggtgatccacctgcctcagcctctcaaagtactgggaatacaggtgtgagccactgcgcccagctgcctagagccacttctttaagattttctcttatatttttcccgaaagtcttatagttttacatttacatttaagtgtgttattcatttttagttaatttttgcaaaagttgtgagacttgggtcaaggttacttttgttgtggatgtccagttgctccattgttggaaagggtatcctttctctattgaatcgcttttctacttttgtgaaaatcagttggggctgggcgtggtggctcacacctgtaagcccaacactttgggaggctgaggccagaggatggcagcctggacaacacggcaagatcccgtctctacaagaaataaaaaaattagctgggtatggtggtgcacacttgtggtcccagctacttgagatgctgaggtgggaggattgtttgagcctgggaggtcaagtctgcagtgatatataataacgccattgcactccagcctaggtgacagagcgagaccctgtctctattaaaaaagaaaatatcagttgggcatacttttattctgggttctccattttgtgttgttgatctatatgtctgtccctctgacaatgcctcatactgttgattatggtagctttgtaatgtcttgaaatcaagtagactgattcttcctactttattattttccaaaattgttctagctagtctagttcctttgacttcccatataaatatacctacaaagaaatcttctgagatttgatagtaattgtgttgaacctgtaaatcaatttggggagaattcacatgtttttactatgttgaatctcctaatccataaacatggtatggctctccatttatttagatctttgatttctttcatcagcattttgtagtttgcggcatacaaatcctatacctgttttgttagatttacacctaagtatttattttttatttttgaggaattgtaaatgatactgtatttttaattttggtgtttgtgtgttcattgctagtatattgaaatgcaattgatatttatatgtttgccttataccttgcaactttgctaaagtcgcttattagttctaggaggattttttgtttgttttagattccttgggatttttcaatgtaaacaatcatgtcatctacaaataggtacagttttatttcttcctttttcttttgagtcgttttcttcctctgttgcccaggctggagtgcagtggcatgatctcggctcactgcaacctctgcctcccagattcaagtgattctcctgccttagcctcctgagtaggtgggattacaggcatgctaatttttttgtatttttagtagagacggggtttcaccatgttggcgaggctggttttgaacacctgacctcaagtgatccacccaccttgacctcccagagtgccaggattacaggtgtgagccactgtgcccagccaggacagttttatttcttcatttctgatctgtatgccttttatttccttttcatgtcttatcacactggctagaaagtttaacactatattgaataaaagtgctaacagtagacatctttgtcttgttcctgatctacgtggaaagcattcagtcttcttctttttttttttttttttttgcttttttgaagatggagtctcactctgtcacccaggctggagtgcagtggcacaatttcggctcactgcaacctctgcctcccgagttcaagcaattctcctgcctcagccttccaagtagctgggattacaggtgcgcaccaccacgcctggctaattttttgtattttagtagagacggggtttcactgtgttgcccaggctggtcttgaactcctgagctcaggcaatccccgcccgccttggcctcccaaagtgctgggattacaggcgtgagccactgcatccggccaagcattcagcctttaaccattaattatgtaatgttagctttcgggagtttctgtagatgctctttagcaagttgaggaatttctcctctattccagtttttctaagatttttttttttctgagaaatgtccctctattccagtctttaccatgagtggattttgaatttgtctaatgttttctctgcattgatagatgtgattatgtgacttttcttagcctgttaatatggtagattacattgactgatttttcagatcttgaacctgccttgtaccctctaaagtccacttggtcgtggtatatgattatttttatatattactgaattctatttgctagtattttgttaagaatttaaaaatctgtattcatgagggtctgtagtttgcattttttgtactgacattttctggttttggtatcaggataatactacttcataaagtaaactgggaagtattcctaacttttctttttttctggaagaaattaggtaaagtttgtgttaattcttcgttaaataattggtagaattctgagtgaaatattctctacttagaagtttgtttgtttgtttgtttgttttcatttttttttggcttttttttttggtgtgaaagggtgagtttaaaaaaatttcaaattcaaatttccctaattgttatagggctactcatattacctgcttaatattgagtgagttgtatttttcaagcagttggtccatgtcttctaaactgtcaaattttatgtgtagttatttatttatttatttatttatttatttatttatttatttgttgagatggagtctcgctctgtcacccaggctggagtgcagtggcgtgatctcggctcactgcaagctccacctcctgggttcaagccattctcctgcctcagcctcccgagtagctgggactacaggcgcccgccaccatgcccagctaattttttatatttttagtagagatggggtttcactgtgttaggcaggatggtctcgatctcctgacctcgtgatcctgccgcctcggcctcccgaagttctgggattacaggtgtgagccaccgtgcctagccgtgtgtatagttattcatattatattcccctttatcctttttgagtctgtggagtctgtagtgatatccccagtttcattcctgccattggtaatctgtatattctttctctttttttgtcagaagtttgtcaattttataattttttttcagaaccagctatttgtctcactcgtttttctctatttttttttcccatttcaccgagttctgctcttctttattatttccttatctgaaaaacagagctagtcttacccatctcctacagtgtgagaattaagtgaaatgacaaatacacgtacctaggacagaagcagaagtgtagattattttgtaaaatgtgatttttttcccccttgaactagctcccttaatagaatctcctacttaggaatcatggcagttaaaaaaaaagaatctacctgccttagtgtggtgtaccttgcccagtgtttcaggctttgctttcttaagatttttcttttttttttcaaaatcacacttgactcatgttatgtctagatttacatatacataaatttgagaggaataagaatagtttagtattgcaaactactcctcggccaccatggctcctgttgcaaacactgcagggattcatgaatattccagaaccacctgttgggatggaaagaaaaagaaaatggaaaatggaacttggcacctctggcaaagtgtaagaatgtattgtattcatcctatctgaaaccagtttaacagactgaatcttttgtgtgatctgttgtcaaagcccctcccggctttgcactccgtattcccaaccagaccagtctccactgtgggcagtggtacaactcacaaaccctcacagcgttcagacgcactcttttttgtttcaaggacaaggaaaagagatgtgaagtgtttcttggggcccagatggtgttattcataacagttgatggttagggttacaagattatatattcccatatagaatattcacacattatataagtattacttcatataatgtttatatatgtttaaatataaacatattacaaacatgtatatatttatgtaatataaatataacaaaatatagtataaaatatatattatatattccctatgtatatataataaagccacacctccaatttcaatccaaccactcagggttctttctagccttgcccctttctctgcttgtaaccatcatctctggtagtagtgagaaacatggctgccagtatcctcaatttatgtacctatttgctcaatataaccagtctcaaatccttctcccacctgccacctgcacccaactccccattccccaccctccagcctcactgaccaacccacccctctgcatgactccataacatcctttcactgccccatactcagctcccatgctgaccccttgccctgggaagggaaaaaaaattgggcacaggagctttttaaaaatggtatattataaagccaattaaatgtgcttcgtacttctagttgtttgcattatcagaaagcaagatttcctgctttctttgttgagaaaggtacttcttattgcttaggaaagttttgttttatttttttgagacagggtctcactatgttgcccaggctagtctccaactcctgggttcaagccatcctcctgcctcagcctccagagtagctgggaatataggtgtgagccactgcacctgacatgttgcctagaaatgctgaaatgggggtgaatgagaaatgctgtccctgcaggtaacttggtcaggttccagtatcccatactcccttatggaagaggagaaaagggaaagaattgtaggatcccaccatataacaagttttatgttccagaagaaagttctgcttttctggttctgtgtaatcatcacattggatggaagggaagctgaaggtctttccactgaattcatggaatattaaagttccagtccttgaacttgggtgtgaccttctgaaatgttcaagtttgtcagtggaaaacatgatcagatctcttatgctgcttttcctggctgctgacacacagtagattctcagtgttgtgtgttctcttttcctgaaagtttgtgcatgttactgagtttgccattgaattgtctttgtttgcatattgatttccacttcaaaaagtagtttaatactgtgaaagtactgttcctaagcaaattacagtacagatggtcagagtagaagtgtgtactcttgatacttccctcttccccctcaacagtggaatcttgctgggattttgtcagtgctgtttagatgggacgtttatccttatttgatcaatcccaaaaggcagcccctttgtggtagttttatactgtgaaaattagttttggaacattaagccaagaagtttgcaataaaatcaaatttgtttatgtattcatttgagacagggtcttgctgtgtcacccaggatgcagtgcagtggtatgatcatggcccactgcagccttgacctcctggtcccaagtgatcctcccgcctcagcctctggaatagtctggatggaccacaggcatgcaccaccatgcctggataatttgttatttttgtagacagagtcttactatgttgctcaggctggtcttgaactcctgggctcaagtgatcctcctgccttgacctcctacagtgctgggactacaggtgtgagccactgtgcctgatcccaacatacatttaataatctacattgcagggaattacattaggaaccatgtgtgggggaccagaagataagacttgcacgtagtcaatgcagtaatgagaagaccataagaaaagtctgtataagagagggcataggcatgactttgttctgtcctcttggccacatcctggctgtgtgaccttaagcaaattaacctaccaactacaaccattccttctgttgggaggagccaaatctgtgggagtggaaaaatcactgagaagaagccaaactctaggatgttgctgtagaaagggcctacacaccctgctgtagaaagggtcctagagtttggcttattttgtgtactggggatcactatgtctccttgcaaaccattgcactgggcgcggtggctcacacttctcacacttgtaatcccagcactttgggaggccaaggcaggcagatcacgaggtcaggagttcaagaccatcctgaccaacatagtgaaaccccgtctctactgaaaatacaaaaattagccaggcatagtggcgcacgtctgttaatcccagctactcaggaggttgaggcaggagaattgcttgaacacgggaggcggaggttgcagttagccaagatcacgccactgcactccagtctgggtggcagagctagactccatctattaaaaaaaaaaaaaaaaatctgtcttttcaaactctagtcttttatcaggtaaacattttctaagttttattcattttttttggaacaagtaagacagtttacttattcaaaatgtaaagggttacagtgaaaagttttgctcctgcccctttgcccagccaccaagttcacccaccagtggtggggaatgtggtatctttctagaactattcagtgtgtctggaagcaaaaggatatccttttacctttctgtatgcaaatagtaacgtaaatggacacaccattctgcacgtgcgcattttctcttttcagtgtattttggaaatcattcctatcattccataaagaacctcctcgttctggtccccatctctctggcacttgttttatgatttctcagtggttactgatagcagttcacagcctcattcccaagttatctccgtgtttggggtttaatttccctgggccaggatatttacattcatgagatggtttccttggactttagtttcctcccactaaggtttgagctacactttgcaaatgggcaaagaccatttttggatgtatatgcctgagggaagacagaaaaacaaagctgaaagagcatccagagggtttgccttcaccatcggaaaccactcagctccttttcagggctagcttttcagactgctttccgagatttctgcccactcctgtttggccatggccgtgtgccctattttcagtttctatatatgccctcatgttttcctgagcacatcaagaacgcctgcacggttacactggtttatttaggaaccgtcccctttcttcttcagtctgtcagttactcatttgaggtcagactcacaattctgcgaatgtcttagcctcttggaggagcatcgtgtgtgatgttggacaagctgcttagtgtctctcagctggtttcctcatccataagatggagttaatcgtgcccattacagagaattgtgacaagcaaatgaaatgacacatctgcagaactaagagcagaaactgaaatatagatatttttataaaatgtgatttttccctcaaataatcttctttaacagaatatcctacttaggaattatggcaaaacaaaaacaaacttaaaaaaatccacctgccttagactcttggtcatcttttaagattcttcaagttttgctttctttttttatttcctttaaaaggtttttttaaaattaaatctttattttatttattattttgttttttgagacagagtctaactccattgcccaggctggagtgcagtggcacaatcttggcttactgcaacctctgcctcccgggttcaagtgattctcatacctcagcctcctgagtagctgggattacaggtccatgccaccaagcccagctaatttttgtattttttactagagatgggttttcggcatgttgaccaggctggtctcgaactcctgacctcaaataatccgcccttccacctcccaaagtactaggattacaggcgtgagccaccgtacccagccctttattttattttatttttatgcaacagggtctcactctgttgcccaggctggagtgcagtggtgcaatcatggctcactgcagccttgaactcctgggctcaagcagccctcccaccccagcctcctgagtagctgggactacaggtgggcaccttcatgcccagctaaattttgtttgtagagatggggtgtcactatgttgcccagggtggtcttgaactcatgttcaatcaatgttcctgctgtagcctcccaaagtgctgggattacaggcatgagccaccaggcctagcttgagtcttaatttttttttggagtttccatacaccctctgcccccacacatgtacagcctctcccattatcaacatcccccaccagcgtggtacattgacatgacagatcattgtcacccaaagtccatagtttaagtttgggttcacttttggtggtgtacattctgtgggtttgaatgaatgtataatgccacgtatcggcaattgtaatatcacacagagtagtttcactgcccccaaaatcctctgtgctctgcccgttcatccctccctcatccctagtccctggaaaccactgatctttttactgtcccatagttttgcctttcctagaatgtcacatagttggaatcatacagtatgtcaccttttatattggcttctttcacttagtaatacacatttaagtttcctccatgtcttttcatggcttgatagttcatttctttttagcactgaataatattccattttctggatgtacaacagtttatttatccattctcctactgaaggacatcctggttgcttccaagtgttggcaattatgaataaagcttctataaatactcgtgaagctttgctttaagatgacatgtttttttctccccaagttaccatcacttatcaaccagttcttttttggtcaatattaaatttttccatttttggctccaactagtaaaaatagggccagattttgactaatagatgaaagaatattctggttagctgcagcaattcagagacaagcatgttgctccaggaagtaaggaactccatgtgcttgctagagaggtactcattctctacaagtggaggagctatggagtgacaggattggaagactttcatcaaagtcctttccaaccctgaaggggctgctattaaggtcaaagacctgttcttgggtacattttcttgtatcctcccatgtgggaagctctgttccaagcctttgggttacaagatagacagaagtccttgatgattcccaaacctgcatctcggatcccaacttgcccgttgtactccagaaacactcctcccactgtttgctgaaaatgtctggggaatattctgcatgtgtattcattcattccttcaatacatatttagtgtctactatgttccaggcatctttctgggtgctagggatgcagcagttaacgacaacaaaaaaagtccctgctctcatggatcttacatttcattctcaacatgtcttaaccaaacccatcatcctcgtttcattatagagttgtttaactgctttctctagcatctggatttgtcctaactgaagtggcatttctcagtcctccagatacattctagtgttatctttattaacttcctttctctcaacatgtaattgtcatctacagttgcatcttacacttcttatttatttatttatttattttttgagacgaaatctcgctcttgtctcccaggctagggtgcaattgcgcaatctcggctcactgcaacctccgcctccccggttcaagcaattctcctgcctcagcctactgagtagctgggatgacaggtgcccatcaccacgcctggctaattttttgtatttttagtagagacggggtttcgctatgttggccaggctggtcttgaactcctgacgttgtgatccgcctgtctcagcctcccaaagtgccgggattacaggtgtgagccaccgcacccagcccacttctttttatttcttttgcattcccctgacttcacccaacacagcatctcttacccaaagcacagtagcttcctgacttgagttgctgctggtggttaatgcttactctctcgtcctatgtgagtaggatcattttcggcccatcaattgaaaaagttggctaaaccagggaaacctaaaaaaattaaactatacttttaaacattttattttcacccaaaacatataactgcacatttgttcactcatctttagttatagagccaagacattgtcttacagtggtcttgttgattgaagtttttttaaacatctttccattcttatatctcctatgatttccagttttagtttttttaaacatgagaaagaacgaaaatacttaagaggaagattggatactgaatcctttcacatgtttgcaaatattcctctattataattgcttcagccatttttagtgactcatcttcattgagtcttttcaaaccattcagcatgtcttttgaggaagcgatatctctccctctttgtactcatatttcactagttaatgtacaaagttatggaaataaatttgcaagtacaactagcataaataggtttgggaacaaatatgcttgactcttactatgaagacaacccacatgatgggagcatgagtgcccaggtgtcccagagaggagactaccagccaaaagtgttcatcttgccaagggtgtcagtcagtgtgtcctgtaaacatggggtgcattggttattttggtgaattgattatctgtaaaatgttcagtagagagtgcataagagagcaacttctgtattaccagagtaatcttcctaagccacagctgtcatgagatcacttctctgctcgaaaaccttcaagcactcctcactggttgaggggccaagggcaacatcttgccttgtgattcattgtgatctatggctgtcttacctccctcccccgttggtgccttgactgtgaccttttcacagtcactctggtgaacaacgacggggcctgctgccggggccttgcttgtctaggctgtgcatgtccaagccaagcccctccctccctgctgcccccttctctcctcctgccactgcagaccttgatggatatgctgttcacctggaaaggacccgctcatagtagcacctccttcaaaaagcgtttcttgagctcctttcaacagggcatgctttttcctttaaaaacccttctgcagcaccccatgtgtatttgttaagtcactcccatatcctacctatactgcttctcctgcctaataactctctgttgccgtgagttgaacccagctcactggacctgctcgctgctcattcagcaagcaggcaactcctgagtatgggcgatgctgtcccctttatctcctcttcttcaaagactgtgtgtctttgaatgcgagctcaccaggctcccccaggcttcagtcatgctaactgattcagagcgaggacatggctcttttgaggttgtaaataatacatcaagtcttgaaggcttatctgcttgtctcccttgactttttcaagaagcagctttattgataataatttacataccataaaattcacccatttacagtgtgcaatccagtgaattttagtgaattgactgagttacaaccatcaccgcagatgagttttaagatattcctgtcactccagaaataccccatgctgctgtttccagtcaatatctgtttccaccaccagctccaggcaaccactaatctgttttttatccgtatagctcctcccttgactctccctgccacttcctcagaattggagtgttttctggactaatgtgtgtgctatttgcctaaggaacttttcttccgattcagttacgtaactttgtgatcttctctttcactcattctccccatgttcaagtttctcttggttttctttgttgtgtgaacctagtctctgttcaccgagttggcctttggcttattaagaaaactgagctttttcccctctttcagaatatggaaaacttgaatagtgtcatgtacaaatattgtagtgtcatgtacaaaccagatgctgaatgttatctaccgaatgaaggaatctgagccctgctaaggcatgggaaatcttgtcttctgttacattcagcatagtgcgtgtaaagtcactaaattattattttggttaataaatactttttattttttggtaaggaaaattacattgtttttattaagatgattcatgcttgatagcttaaagagtacaaacaaagtaataccttaaaaagaaaagtataatatgatccagtatttccacttctggttatatacccaaaataattgaaagcaggaacttgaaaagatatttgtgcgcccgtgttcttagcagcattgtttgcaataactaaaaggtggaagcaacccaagtgtccatcaacagatgcgtagatcaacaaaaatgtggtatatacatacaacagaatgtcaggccagccttaaaaagaaagaatttctgacacgtgctacagcatgtgctacctcaaagacattatgctgagtaaaaggattgtgtgatcattcctatgagggacctagagtcaccaaatccatagagacagaaagttgaatggtgattgccagcggctgcgggaggagggagtagagagttattcttttataggtaccaagttttggttgtgcaagatgaaaagagttctggaaatgggggtggtgatggttgtacaacaatgtgaatgtacttaacacctctggactgtacactaaaaatagttgagatgccagcctggctgacacagtgaaagcctatctttaccaaaaaaaaaaaaaccaacaaaaattagccaggcatggtggtgcgtgcctgtagtcacagctactcgggaggctaaggcaggagaatcacttgaacctgggaggtggaggtttcagtgagctgagatcgcgccactgtactctagccttggttgacagagtgagaccctgtctcaaaaaaaataataattgagatggtgagttttatgttacatatattttaccacaattaaaaaataaaaataataaagggaataacagaagaagaacagagaagaaagttaaagtactatctgaaacaccacgtcttagaaacaaccagtgtttgccacaggaatattctttataggaaaaaaaaaaaaaagcctgggcaacgtggcaaaaccccatctctatcaaaaatacaaaactttagccaaccgtggtggtacgtgcctgtggtcccagctactcaggaggctgaggcaggaggattgcttgagcccaggaagtcgaggctgtagtgagctgtgatggcactactgcacgccagcctgggtaacagagcaagatcaagtttcaaaaaaaaaaaaaaaagtccgagcgtggtggctcatgcctgtaatcccagcactttggcaggccgaggcgggcagatcacttgaggtcaggggtttgaaaccagcctggccaacatagtgaaaccctgtctctactaaaaatacaaaatttagctgggcatggtggcacgtgcctgtaatcccaggtacttgggaggctgaggcacgagaatggcttgaacctgggaggcggaggttgagccactgcactccagcctgtgcaacagaggtaagactctgtctcaaaaaaaaaacaaaaaaacaaccagtgtatggggatggttttctaagcatctctttcagcggtggtaccttcgtaacgacaaataccagtacaggttcagagtagggggaatccattcagagtccttgagaggaggcctgcagcagggatggggggctgatcacgcaaggcaggaaagttgtctgtacctgcagcagtgagtgcctgataggcctgtggggcggcttcagtgcccaccacagggcgtgggggagcccaggcaacagggagcctccttctgccattagtggagggaggggcctaggctgctgaggttgagcttcccaagggagttctgtagaggagagaataaagagcacactatgtgagttcactgagagtcctcgctttgagaaaaggtgacacactcctgggactcccagaaatactgcgggaactttgcagttgggacgataagtaaatgactagggccagaaaaatattatttaatactgtttttttcttttctttttttttttttttttttttttttttgaggcagggtctctgtctgtcaccgaggctggagtgcagtggtgcgatcacagctcactgctgccttgacctcctgggctcaagctcaagtgattctcctgcctcagactcccaagtagctgggactacaggtgcataccatcatgctcggctaatttttttactttttgtagagatgtggtctccctgtgttgcccaggctggtctcgaactactgagctcaagtgatcttcttgccttggcctcccaaagtgctgggattgcaggtgtgagccactgtgcccagccagtactgttaacatgaccccattggtacccctagacttgttggtctagggaaacatgagacacacaaaatacataggaaggtgttcagcctataattttcctttatatataagtgaacttcaaaatcttgaaggccaatgatgactttgatttttctgttttagcaatagggtcttgctatgttgcttagattagactggagcttctgggctcaggcaatcctcctgcctcagcctcccaaatagctggggctactggcatgcattactatgcctggctcaatgaagattttttatatttgtaccaaggtctcaaagaaggcagtgggcagataatagaggtgtcacacgctaggaggatggatcacctaatgaatcagtggctgagacaagtacagaggttttttttgtgtgtatagttttatagtgattgatatcagtcttctttcatttagattatagcaaggttattcatatttaagttaagccctattaaggctaaaaacattctaattcaagaaggatgttcaagattctctccttaaagatattacatattttatagtttgctgtttaaagaaactatttgttttctgtgaatcctgaaatgttgatttctctttgaagattctgtgtccagcttctactggagacaaagtggtttagtgtaggaagaacgagtgcttcagtggcaacaggcctgcattaaatttcagctccctacttttaatctatatgaccttgggcaagatagcgtaatctccctgaacctcggtctcttgcttgtaagtagagaaaaagaatggctactgggtcagaccacaccggattcgctggattgtaacactgaggaagtgtgccaagtgcgtaacagaatggaaagtaggtaactcagagggtgtttaattcaggggttcggcatgccaaaaagggtgcaggttctttccatctttttggtcgaccaccctgattgtgctggcttggccctctggccagctcccctcgtcatcacgagataactactagagttctggcaacctcaaaccgaggacagagtcccatggaagaagaaggtttcagtatctctttaagaataagagaactttccccagccttcctcccagcagacctcccttcaaatgtttttggtcagaactgggtctcatagcatccttgacctagtcactagcaaggaaaatggaatcaccaggattaacgtaggctgtgcatgaaggatctactactcagctaagaacaggccaccttctctcagggccagctccctggcaggcaggaaggaaggaaggaagatgtgggaaatggctgataggtagtccacagagactgccacacttgttttgtggtgttaatttaaggtctagtttattatttggatcaggaatgtttaaaaaattaatgggctttatcttttagaggtattgtaggtttatagaaaagttagtggaaagtatagaaagtttccatatataccccctcaccatcacctccagactcccaagttactaacttcttgcattaggatggtacatttcttggaattgatgagccagtgtaagtacattgttattaactaaagtccatagtttatgttagggttcacttttggtggtgtacattctatgggttttgacacgtatccaccattacagagtcatacagagtagtttccctgccctaaaaatcgcctgtgctccacccgttcatccttcctcctaagtgcctggcaaccactgatcttactgtctctacaggtttgccttttttgtcagatagctggaatgatgtagtgtagctgaaaagaagtggccttttcagaccggcttctttcacttagcagtatgcatttaaggttcctccatgtctttttgtgtcttgatcatttctttttagtgctgaataatattccattatatggatgtaccacagtttatcattcaactattgaaggatatttttgttgcttccaagttttggcaattatgaataaaactgctataaacattcatgtgcaggtttttgtgtagacctaagttttcagctcatttgggtagatatcaagaagctcaactgctggatcttatgataagaatatgtttagttttgtaagaaactgacgctgggcatggtggttcacgcctgtaatcctggaactttgggaggctgaggcgggtggaacatgaggtcaggagttcaagaccagcctggccaacatggcaaaaccctgtctctactaaaaatacaaaaaattagctgggcatggtggcgggtgcctgtaatcccagctacttgggaggctgaggcaggagaattgcttgaacccaggaggtggaagttgcagtgagctgagattgcaccactgcactccagcctgggcaataagagcaaaactctgtctcaaaaaacaaaacaaaacaaaactgacaaactgtctttcaaaatggttgtaccattttgcatttccaccagcaatgaatgagagtttctgttgttctacatccttgccagcatttggtgttgtcagtcttttggattttcaccattctaataggtgcataacagtatggatcgtgatttttttttttttttttttgagacggagtttcgctcttgtttcccaggctggagtgcttggctcaccgcaggctccgcctcctgggttcaagtgattctcctgcctcagcctcctgagtagctgggattacagatatgcaccaccatgcccggctaattttgtatttttagtaaagacagggtttctccatgttggtcaggctggtctcgatctcacaacctcaggtgatctgcctgccttggcctcccaaagtgctgagattaacaggtgtgagccaccatgcctggccatggatcatgatttaaaaaaaatactggcacaaggaaatttgaactctggctatttggtaaaaaattattgttaatattttttagttgagataatggaattgtgtgtgtgttttttaaagagttcttatctttagaaatccatgctgaaatatttaccaatgaaataggatgtcttggatttgcttcaaaataattgaagctagaggaagaagtgggtgatagatgaaaaaaattggctctgagttggaaactattgaaactgagttgagaggcatatggagggccattatattagttctctttagttttgtgtatgttgcggcttttcataaaaggtttttactaattaaagtttaatcatgtattatttaaaaatgatagagacagggtgcaatggctcatgctataatcccaacacttcaggaggccaagtagggaaaattgctggaggcctggagttcaaggccagtctgggcaacatagtgagatcccatatctataaaacatttaaaaaagttagctgggtgtgatgacatgaggctataatcccagctacttgggagggaggctgaggtgggaggatcatttgagcccaggagttcgagactgcagtgagctataattgggccactgtattcaagcctgggcaatagagcaagactctgtctcaaaataagaaaaaagatggacactttggtgtttagtaaaaattaggaactgtcttctggtcctacctttgcttaagtttagttcttaacagtattctgaggaataaatgaatatttgttgaatatatatgtattagagtttattattcaaggaatcttcctagaaactgaagatttttggtaatatgataaattttacttgaaattattatttttagagatagggtctcactctgtggcccaggctggagtgcagtagtgcaatcatagctcactgcaaccttgaactcctgggctcaagtggttctcccacctcagcctcccgagtaactgggactacaggtgcacactaccacacttggctgattttttattttttctagagatagggtcttgtgctgtttcccaggctgaattttactttaaattattttaacatttatgtatttttccaaataaatgtatttttaactcaaaagcaaaaagcagtacatgtgcactagaaaaaaaaaaaaaaggacaagcaataaaagaacttatataaaggacatcataatcttgcctactcagagagggccactctcaatcagtgccttgaggtataattgttgaaaccctttccatcttatccaggtatctgtgtctatatagtttttgtttatgtacaaaaatttagaattgtattcttttttttttgagacagagttttgctcttgttgcccaggctggagtgcagtggcgcgttctcggctcactgcagcctctgcctcccaggttcaagcgattctcctgcctcaggctcccgagtagccgagattacaggcacctgccactgcgcccagctattgttttgtatttttagtagagacggggtttcaccatgttggccaggctggtctcaaactcctgacctcaggcaatcccgcctgcctcagcctcccaaagtgctgggattacaggggtaggccaccacccctcgcccagcggattacattcttaacatatgtactgttttgcttttaacttagtatctgacacatagctttagagactgcataggaagccatcatatagctgtattatattttattaaacttggacatttgtgttgaacattgtaggtttttccagctttttgctattacaaacagaaaggaggcaacgtgcagttgttaagaacacaaactctggagttaaatggcatggtttctctgcagaaaagggtgaatgtagcaggtctgggactgctgtccttagaaaggctgcttccaaggttggcacttggctcgtgtcagggaacttggatttcggaagggttcctgccaccctaattggtaagagtggctcactgcataaactgtgcaaacactgtagtttatgctgaactcctgttttccttccaggagcctatgtgatcgcctggtaaaaaccctggatgctaagtctctagtgaatttccctggcagacatttcacacgtgttgtcacagctcattgctggaagaattaagcacaccctgaatgactacactggggggaaattcatggaagcttgcacctagtttcctctggacttggtcttgtagaccttttcccttttctttgtatccttttgctgtcatatatcatagctctgagtgcaactgtgtgctgagtcttgtgagtcctttcagagaatcaccaaaccttggggtggacttggggacacaggtttaaatcctggctctgctgctttctagcggagtaaacttaggcaagttactcaccctctcagtcattttctaatctttaatttgagttaaaaaaacagttttgttttataaatcgaaatatataatgtacttagaatagtgcctggcatgtaattatttctcaacaaatgttaagaattatcttgcaagctagatgtttgtgtatatttgtaactatttcttttcttctttttttttctgagatggagtctcactctgtctcccaggctggagtgcagaggtgcgatctcggctcactgcaagctccgcctcccgggttcacaccattatcctgcctcagcctcccgagtagctgggactacaggcgcccgccaccacgcccggctaatttttttgtattttttttttagtatagtagagacagggtttcaccgttttagtccggatggtctcgatctcctgacctggtgatctgcccgcctcagcctcctaaagtgctgggattacaggcgtgagccactgtgcccggccttttttctttttttttttgggacggagtctcagctcatcacaacctttgcctcacaggttcaagtgattttttctgcctcagcctcccaagtagctgggatcatccctgcactttgggaggccgaggcgggcagatcacctgaggtcgggagttcgagactagcctgaccaacatggagaaatcccgtctctactaaaaatactaaattagccaggtgtggtggtgcatgcctgtaatcccagctactcgggaggctgaggcaggagaatcgcttgaactcgggaggcggaggttgcagtgagccgagatcgcaccactgcactccaacctgggcaacgagtgaaactctgtctcaaaaaaaaaaaaaagtgctgggattacaggtttgagccaccgtgactggcctgtaactatttctttcaaataaatttctgtaagaataactgctgagcttaaggatatgtactttttttaatgtgttctggtcatagtagtaaaatatatttattaagacagatatttggtatagaaaaaaagtctttcctaattctatatttcagatatagttatttctaataatttgctatatacatgtcaaaatttatttctacacatattaatatggacagtagaatatagaaatttttaataaaaatgggaccacatatatattattttattgtttatgcctgtatataagggatctttatattcagtgaagttccataaaaacctttttgtcttccttaaaacgcttagattataggtgaagtaaaaaatatgtaattataatgtccaagttgtcaacttagttatacctttacatttgaaattacacattatagaaatacagtaatttagaaattacagacagtccctgacttatgatggtttgacttaggattttttgactttgtgatggtacaaaagctatactgtacttcaaattttgaattttgatcttttaccaggctagtgatatgtggagctacacttttttgtgatgctgggcagtggttgtgagccgcagctcctagtcagccctgcaatcatgggggtaaaccttcaacagtactgcgttgtcagcatttttttgaatattgtttgccagcatttttgcatccatcctgtctacaaagcccatctcgacttagaatattttcagtttacaatgggttattgggacgtaacccatcataagttgaggagtgtctgtacactgttgctttttttatagtcatcacaggcgtctttgacatgtcaccctgtcaccatgatcatcagagccacttttaaggtttacatcagatacacagcacatcagcttcacttccgcgtgttgcttgattccactggactctttgattccacaggaaattttatcctgttcatataacattcaggcagttggtttttcatttgcccaggatgtgtgactgccacaacctgactgatccctgaactgctttttaaaattatccatggctgggcatggtggctcatgcctgtaatcccagcactttgggaggccaactcaggtggatcacctgaggtcaggagttcgagaccagcctgaccaacatggtgaaaccctgtctctacttaaaatagaaaaattagctgggcatggtggcaggcgcctgtaatcccagctacttgggaggctgaggcaggagaatcgcttgaacccgggaggctcttgtctttgacatgctagttctgtgggagaaaccccagctgggcctggtggctcatgcctgtaatcccagctactcgggaggcagagggaggtggatcacttgaggtcaggagtttgagaccagcctgaccaacatggtgaaaccccatctctacaaaaataaaaaaattagccaggcatggtagcatgcacctgtaatcccagctacttgggaggctgaggcacgaaaatcacttaaacccaggaggcggagattgcagtgagctgagatcacgctattgcactccagcctgggcaacagagcaaaactgtctcaaaaaataaaataaaataaaataatacaagcattgacaggtacagaagtaccatgagggagacagcattgaattctgtctgagatgtgcaggcagaccaaaggggggtgataacagagcaagaatttaaaagatgatatatattactctgcttcagctgccataaccaattgcacagactggatggcttaaacagcagaaatttatttctcggagtgttggaggctggaagcctgagttcagagtgccagcatggctgggttctggtgaggagtcttcttggcttatacatgccaccatctcactgtgacctcacataacagaaagagagagagagaaagatctcttcctcttctttttttatttttatttgttttattttgttttgttttttgagatggagtcttgctctgttgccaggctggagtacaatggtgcgatctcggctcactgcaacctctgcctcccgggttcaagcgattctcctgcctcagctgagaaggtgggactagaggcacgtgccaccacgcctagctaatttttgtatttttggtagagatggggtttcaccatgttggccagatggtcttgatctcttgacctcgtgatctgcctgcctcagcctcccaaagtgctgggattacaggcgtgagcctccgccagcctcttcctcttcttataaggccacctatcctgctagattagggccccccacccttatgacctcatttaaccttaattacctcctaaaggccctgtctccaaatactatcacattgtggggggtagggcttcaacatgaatttaggaaggacacaactcagttcacagcagatgaataagcatttgccaggcagctcagttatggacgaggtgttgaaaccgacggaatatagcagatatgaaagcatagaggcctgaaacaatagggtgtgttcagggagctacagctggctcaacattgctgtaatataagttgggagggagaacttctgaaagctgaggctagaacaataggggtggaggtggagcacatgattatgaaggaccttggtatactaagcttagaaggacttcatcttaagggtagaggggagccacaggaacttctaggcagaggcatggcgcagtcagatttgcatttttgataattcaggtggaggagcaatttaagtagcagcgaaagtggaagtagtaagttagttgggaagctaatgcagtagcccttgtgaagcaaagatgcagcaaagacaagagaggcaaagtctggaaaatgttaaggtgatgaaatgtgcaggacttgactagatattttaaatgtgggaggtgagagagccataggagtccaggttgggttggggtcttacttgtccagtttccataaagagacatgttaattacttgacattttacagaattagtatattgactcattgatttccaaaactctttgaataagtatgtaactgttctgtagattgaagttgtgtcactcttaccatgatcacaaactcaggctctgcctatcattttggaactatttggggaagtcgaccatcttttctgggctagttacctttttaaaaggggagggagttgcacttggtgtcatatgcatttctgctctaacattgtttcctgctatttattttccttagtatatttgcttgtacatgctcagtattgtgctgtgttttatagattacagaaataaaactgtgactcttgtctttgacacgctagttttgtggcagaaaccaactcatggtactatactaccactaaaaagaagtaatgtgtatttaagggctaatttgtgtctgctgcctgcagcctatacattggttcattcatttgttttcattcatttgttccgagtctctgtgtttataaagtttacactctagtggaggaacaataattagtaaacatgtagtatatggaatggtgatcagtgtcacagaggccagcaaagtaggagagggtgtgtgctgagggtctggcttactatttaatgtggtgcgatgagagaagcccccttagtagggtgacatttgagcaaaggcccagggagtgagagagggtgagacataaggtctatgcagtgtaggtgtcgggaggaagaatgttgcaggcagagggaacaccaagtgcaaaggccctgagatgggaacatgccccgcttatttgaggaacagtgaggaggccggtgtagcaacagcaatgtgagaaggggaaggtgagttcactgatgggggaagaggaggattattcagggccttggaggccattgtaagggctttgactttccctccaagtgagacagaaagacactggagcgttgcaagtgggggtgtgacatgatttgacctaggctttagaagcatcactctcactgtatgtgcagaatggactataaagaggcaagggcaggagaagtgagactggttaggaggcagttgcagtaatcctggcaggagatgacagcggcttggatcgggggtagcagtggaggaggtgagaagtgctgagatgtagggctatttatgatacacatactgacaggcgttgttgagggacgagatgtggcatgtgaaaggagtcgaggtttctggcctgagtcactggaagaacggaactgccacttatggagatggagaggactattaaaaaacctaagtggaggtgtcaagagaaggtgtcaagaaggtagttggacaaatgagtctggagttagaagagggaaccagcctggagatatgtagatggtatttgaaagccacaagttggtaaatcaaagaccaagagagtatataggaaagaggtctgttggctgagctttagtgcccagggtgggtcaagatgaggaggaaccaacaaaggggactgggaagaggcttctaggggagtgagcagaaaactaggagagggtagcatcctggaaccaagtgaacacactgtttggaggcgttaggagtaatcagtggtgtcctacgatgttgatgcgtgacacctgagaatggaccgtagtgttcaagtgatgcacgagatagaaccagtcataccactaatggtttttttagtcctaaatatttttactgcaagatttcgttgttctaagtgttttcactgtcagatgaaggatgaaagtcgttcagggtaatttccattttagtaatttccgacagcggcagaacagtttctacttacgattggtatgcatttttattattagccatagtattcattttgggtgagtacgtctttgttagcgttatttttcttcaccacctcctcgagttgttcatccattcattcattcacccaaagaaatgcttattaagcgcctgtcctgcgctagtcctaggtttctcttgtcctgataggtctagcttcacacgagcaggattttgcctttccggcggcactaggcttccgcctcaccgcagtggggtttttccagcctaccttgtgcagctgcggttctcagcatccgcgggcggaggcctgcagccggtcagccggtgcgtcccgcccacggcgcggggccttctggcagccaagaaggaaatacagatgaggtgggcggacagtatgcagatgacgggggcgggccgcgcctggcgggcggtgtgcagttgaggtggtccggcaggatgcagatgaagggggcgggccgcgagggcgggcttgatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagtactctgcacctttttattttatcatatcataggcatccttccaggtcaatacatagaaatctatcttattttaagagcaacatgaccttccataggaaggatatgtcctggaatattaaaatattgtcttactaatgcacaacaaggttataattttttttttatgagtaatgctataatagcagtccttattcatatagtcctatgtagttgtggttttatttttatagaatgggtttttcaaaatactattgctgctctaaagtatatgcacatttttattttaatagatgtctccaattactcacctgagtgctgtgacatttcactcttgaacatgcccatctgtatacatcctgagcagtagtggagagccttgatcatatttttgccaataggataatcaaaaaatactatcttattagcactttaatttgcatttcgctgagttttttttttttttttttttttttttttttttaaagacagggcctcactctgtcacctaggctggagtgcagtggtacagtcatggctcactgcagcctcaacctcctggacttgagcagtcctcccaccccagcctcctgagtagctgggactacaggggcacaccaccatgtccagctaattttttttttttttttttttttttttttttttggtagacacgaggtctcactgtgttgcacagagagactggtatcgaactcctgggctcaagtgatcctcccaactcagcctcccaaagtgcagggattacagccatgagccaccatgcccagccctttctaagcacatctttgtatgtttactaaccactgcattttctcttctaagaattactagttttgcaacttttccctgctttttcactgagctgattgtttttttctcatcagcttataagtcagtattttattagggatacggttgtatcccctatattatgagcctttatcatatttttcatgtgatatggctttatctttatcatagaaaattttatatttttatgtaaactgttagtgttttcctttactcttttttttaagattccttctccccagtattatacaaatgtgctattaaatgtcttcatctacttgatgcacacacatatgcaggccatttgatccacctctctttatttaatctgatgtgaggtgtggttctttttctcccactgggtagcactgtttattaccagagtcatcctttgtccactgaattgaaatcccacctttacatggtttatgtcatccacattcagagagacctgccctagatgtgctcccatttctttctcttttgagttagctctgctttaaaatattcatagattattagattgcttatattacttttaactcatcctttcatttaaaatttttattttattgaattttaaggcagacagtatcagtgttgaactctgtttccagtcatgaatttacaaacgccagtcctctcttgagtgcagtttccccttcactttgtattatgaactgtttgcatcgagcagggcatgattttgcctgtcaccttctcttgctgaagcagatccaggtgtggcagggcctgacgtttgccccaggtccgtgtctgaattctgctcagatccactgcctttgcctgacagtgcttctgatcttcttctcatgacttaaacgtgttgggaggctcttgaaggtacatttgtattacatacttggaggtacagaagcccaggtagagtagagaagggtgagtgcctagttgggaaattcacctgtacccagtttcttctctgcctggtgagcctggaacgcagagccagctctctggatctctttgcgtgcccctcatccattttaggtgcacactgtggctcttcctatcctgccccttgtcactactgccctttatgcctagggtaaaccaaccttggccttctcggatgtaaattcttcttgttcctgatcctttgccaaaacgccgtgcatctctctgggcttctcatgctcctctccagccttggccctctagggtgggggacattagttggggttttcccatatctccattttctttggaagggaattgagggaaagcccttggtattgtattttcattcccccgaccgtgtactctctattagcagaaattcttcagaatctaagccacgtcaatgatactcgactacaggacttttactatttgattcttattgttgggatttgtagattatgatgctggtgttcaaattactttcttatcctgtttgtttttattgttatatatgcttttactgaaatttgaaagtgaaatttagaagatattgtttgacacctaagagacaaagtacttcataatttctgtcttcaaatagagtgaaaaacttctgttagatttgttttatgcaaaataagtatttagaaaaaattacattccaggcaagggcatagaatgagcaaaggcacagaggcagggcataaaagtaaaaaacttcaggtgaatagtccaaaactagatgggcagaggggagtcttgggagattaactgaaagacctggggttgggctttgttcaggtgttcagtaaagagaccggcaggcgtgagcatgtggttgacatgcgacccgccctcttcacaaatattaatctgccaattgtgaaggtagcagtggtgccatacaacactacccaaatggagttaacctttgaatactttaaaaatcatcatgtacaggagctcacctgttcctggatcagaatgaacaatgacataaagtgctgtttttaggaagtaaatgctgtagaccatgactgacatttgaaaactctgttctctaacataacaaggaaagcagcaaattagagaggttaaataaaagttttaaagggaaataattagagacatgtatgtatatgtgcttaaatgacaaggtgaggcatggaaggcagaccgacattcagtgaggagggccatgtgccttgctgtgctccatggagacactgtctgcttatggagtgtgcatcacctgctgtgtgtgacacagcatcaggcggtctggcctgcaactgttgttctctagtatctggcctgcaactgttgttctctagtatgggttgccgccttttaagagcagattattgtataaagataggaacactgaaataacttggtagtattttttaaatgtacttaaaatttaggaagaaataccatcagtattatttctagaaccttgtatatctctcacagaacatttatgcattatagaaaatttgagaaatgcgtggccagagctggatttgcaccccagtttcaccattcatgaatcatgtgaccatggtcaaattttcctctaaaataagggataataatatctagttttgttgaaaattaaattagataatgcttttaagacacatggtactgtgcttggcatatacagtggagttatacacattcatatttgttttgctgaaattatcgattattatcccagttttatatgctgggagcaggtagaatacttgcttcatttttgttgttttaagcatggcccctaaacactaagcacctatttaatgtgtgatgtaactgaagaaagagccaatcatgaaatgctggagggaatgcaagtatgtgagacttctggagagttggtgtgtttgtaaacagtcatgtttacaaaagcatgtacttttgagtgactcaaattattttcatggtttatttgactacatgtgtgattattactttgcaggttgattttagaacctaacatcagccttagaggcagtagcaagccttgaacaagtgtttctccagtagtggtaccttgcagtttttcttttatttaatgctaagacatacctggctgtatacttacatatttcttaatattcattatagaatacagagtttttattcttccttggaacagaggaaatgtaagacttcatttatggctgaggctgttactaattgatcccagccaattctaaaataggctggtgtaaggattttcagcctcatttatgatttaagtacatactaataagccaatagcattcttaataaccattttctttggttattcaattcaggctatgttttgtgaatccctctcacatacacagagagacacacagacacacacacacataccactgttacataacacagtgggtatttctcttctcaaattatacagggttttctcatactgactcttattgttctggccaagtagacttagtgtttgaaataccatctttggatacctgaagcctgaggtaattgattcttgtggccttgctttttaaatttatcatttgatattttgaattgcagataaatttagataactgaaaggaataacctcagcagaatgtaggcgtctccattttgttcttattaaattatcaaagaatgaaatgtaaaatgaattatttaaaatgattgtccttgggggcctttggtactgagtcatttaaatggactggtaagaaggtggccaggcgcagtggctcatgcctgtaatcctggcactttgggaggccaaggcaggcagattgtctgagctcaggaggttgagaccagcctgggcaacatggcgaaaccccatctctactaaaaaaaaaaaatacgaaagattagcaaagtgtgctggtgcttgcctgtagtcccagcaagctacgcaggaggctgaggcattagaatcgcttgaacctgggaggtagaggttgcagtgagccaagatcacaccactgcactccagcctgggcgacagagcgagactctgtctcagaacaaaaaaaaggtggcccattttgtttgttgatgaccttcatgagaatggctagcacagaccgaggaaattattttctgctcaaacctaacctgatttctttttctttctgcatttttgccacctgattttattgtatgggaaagtatgaaaaccagttcctctcaataaaattatttaaaaattattttaaaaacccaacctcctacaatttctgaagtgcctgataatttcttccaatgaagttttcagtttactgattttttttttcactcataagaagggactgtggagtgaagattgtaaggcagtgtggtttaactgttttaagttctgtttctcttaaatttattctattcatgttatttacagagcaacagaagaaagcttagagaattaaagacaaattcaactggagaagcttatgagtagtagctagattaatttgaaaatgatcagtaaataactattttatttactgatttattttaaacttccaccgaccttattgaaatatacttccagaaacattctgtttgaactattatcataaattagtcatcttgcaaaacagctgtggcaatatgatacaatgaagagagcagtgatttagcaatgagaaggttgggagttcttgtcttggctccttcacagggagatcacatgacatgccaaagtcccctatatgaggaagccatgcattgagaggattgaggattgggtcaatgatctatcatagaatgctttctatgagtctagaagcctcatgaagaacacaccaggaaacttgggtgagagcaggagcttcacctcatgcagaattgcagtgtgattttagagtgctgttaccattcttatgcttagaagtcagagtgtctgaatcaggattctgttgtgtataatggattgcactctcgttggcttaggcagaaaggtgttaaatggtttgcagaattgttgggaaggctgagcttccaggagcagctcccaaagtctccacacacaactggaccaccagggaacctgctccctccaccaggacaggagccttaacttcagaaagctgcccacccagttggaaagctgccaccacagttgccagcaccatagcatcttgtctctgctacagtctctgtctacatagtgaatgcccggtgccctgcctctcttcctctgattcaggtcccactccaggtcttgcccaagtctttctgattggtggaacttaaatcacacccaaaatcccagctgtaggagagctgtgagatttcatctttccaaactctgtgtactgcatgggggttggagcacatgtcggcagccggtccactgcattcaccattgacagtaggtgaaatatttatggtcaataacatttgcattttttcacaaaaaatgcacaatttgcagagtagccatacacactttttatttagagctaatatcaagtcactctacatataaaaataattatttctgaccatttcccaagaaaacagctcttctaaaaattgagagcaatgcctacattatttcctaaagatgcaaactggtagagaaaacaggatgttaaattcagaatttcccttccagcttcatttattttctccacatcagttctgttttcctctgtgtctttttctcccatggggatgtcctccatcttttcaatctgatttgctctttgccatgcagacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtatttaatcattttttctataagcaaagctccaaattcaaactttggcccgacatttgatatgtctactatctctactccaccctggccctgtgttgttacaaccacaagggcgctttccaggtcctaccacgtgcagccactgcatgcaggagcctggctgaggctccagggaggcactgatggagagcctggctcatgaataacacaaatgcagcctcttcctctctaccgcttccttccatccagttcctgccttgctacctttcttttctgcctctcatagccattaaattcaggtcactactatttgcctttttgtcatctcatgagaattatgagggtcagctggagacttcatctcctaggaaacgagacatcacatctctgcacctggccctcttggaggcacccctggccatccccatcttgcaacctgctagacgtttttctacctggtcttgtacgtgagcacctgtgctaatctgtcactcctgatctaggtgtgttcccagcttttcctggtgttgtctgatggtctcacaattcccctttagtcatgcttatcttcctatatgagaaagatgcgtagctatacttcatacatatactgtacacataaacatagcaaatagaagaaacagaatgtgcatctgtctacagtaacaatatctttcttccccagagtgcaacaaacatgccattgtattgggagactgtagtaaaagttaatcctaggatgtacctggttgtctctgctaaaattgtttgcacctaaattagattaagactagactctacatattcaaagacatgaaagcctttcatgtctgtgaagacaggaaatgaattaacaatttgtacaagaacttttctgttccttccttctctaggcatctcattatttatacagtttctttttgctcagctatccttcatctaagactgacctccactcagctaaatcttcccttcttgtttccccaaagcagctctagtccggagaagaaaaggataatagagtaaatattacactaaacacggatactccttaagccaccaaaaaaagtaacaagaaatcaggaacaagtatatgctattttgaagtggaacaacatataaatgttcccatgttttttcttggcaggtggagctggacagaatatttctgtccataagacccccagaagtcccctaagtgggataccagtgaggactgctccagcagctgctgtctctccaatgcaggtagatgagccccagaaataaccactgcttatggtttgctgtgtatccctctagatgtttttctttacacatattagtgtccgtgtgtgtatgtgtgtgtgtagagtatgtgttttgtaaattggattgcactatgcattattccaatacttatttcactttatcatcggaatgtaagcttcatgaggtcagatatttttgttcattttgcttgctgttttatctcttgtctgtaacactggttggcacatggtcacattatagtagaagttcaataaatattaaatgaatgaaggaatatgttttcaaattttaatatttgcagaaacgattctttttataaaagattacataatatgtggtgatttatttagccactgttctactgatagaagttaggtttttttggatttaacttattacaaaaaataatacagtgaagatactgatacaaatttttgaccacttaaggggctactttttaaataagggtatatcaagattcatttgtaagtatcagagatgactgtagttaagcagaaaggaatttaatacagggattttggtactgagggctggagaaaggtctaggctgcactgagcttccaggaaaggttcccagagcatctgaaagttggcccattaaaggagcttctgtttctgccagaatcgggaagtctttctctaagtgcttacccaggactgccactgctaccaagatctaggatcagcctggtgactacactgccacaggtgcagtccatgccagaaaagcacactctgtgcctgccccatactgaccagaaaacggtggaacagaccccagaacctctgctcccctgccacagaacagcgaatgccttcccagccatgtttaccaggagaagctgcagaagggaagccttacactcccttgcaccttccagatcctctgagaaggggcctgtttgacagaagctaggccacttgatgagccaagctttaaaggagtttgccaagtacaccctttagcttcccagtcccttatagttcaataagtcgccctacaaggagatgaggatggagttgagtgagcccgtcttgagatcttctacaaattgattcctagtgaaggaaaatggagtcctagaaaaggaaatgtatttgacctgttccagcatgtcgaaaaacttgatagacacattgcccttcagtttgccctcccgcttacagtactattttccaagaattttgacactgtctataatttttgaagatcaagtaagtgaacaataatatcttgttttactttatcagtaaggtggagcacttcttcgtatgattataggccatttatctcttgtgtgtcggtgtggaaacttacatactttgcctgcttttcttttgaagtgttagtctgtttatgttttgtaagaagtattgatatattgtgctttttaacattttttcatatgtaattgtattaccttttttatcttttaatgtcatattaatagttatcttttactgaagagaaattttacatgtttgtgttgtgttttaagattttgttttgtttcctgccttaaaatgtcttttctagctattagatgattaaaatattctccctaaatatcttaaggaagtcttttatttcttcagtcttaaaacccatagaaacatgggtttggatttagatattcttcccctatcttaactgccttctggaagcagaagtaaatactctctggaggacaattacaccatctagatccttaaattatagccacattttaaaaaatacaacgttatatagtaactttaaacaataccaggcatggccaggtgcagtggctcatgcctgtaatcctagcattttgggaggccgaagcaggcagatcacgaggtcaggagttcgagaccagggtggccgacatagtgaaaccccgtctctactaaaaatacaaaaatcaactgggcatggtggtgtgtgcctgttgtcccagccactcaggaggctgaggcaggagaatcacttgaactcaggaggcagaggttgtggtaagctgagatcgcgccactgcattccagcctgggcaacagagcaagactccatcttaaaataaaataaaataaaacaaaaaaccaggcatacaaatagataataccaaatgatgaaaagccaagagaaaaaatagacaatagaaacagacacggaagattcagatattgatattattagacatagaccctaaaacaactgagattaatgctgtcaacaaaataagtgacaaggtagagaatttcagcagaaaaccacaatgtataaaaaagaatctgttagagattttatgacttaaaaataaaatacctgaattaaagactcaataaagtttagctgtagcttaaacagtttaagagaggcttaaagaactgaagacaagtcagtataaatatctgaactgaagcacagagaaaaaggataggaaatagagaaaaggacataagaaacatatgggatggaataaaaaaatctcatgtgtaattggagtccccaaaaggggagaaaaagagcagaagtgatattggaagggataatgatcaagaatttccaaaactgataaaagatgtcaagcccagattcaagaaacaataagaaccccaagtgagataagtacaaagaaaaccacccagacacatgaggttaaaactgctggaaatgaaagagaaagcatcctaaaagcacccaaaagaaaaaagatacctcaatgtccaaggaggaagagcaaaactgacatctttcttctcaagaagaatgatggaagccctgaagacaatgcagtggcatctgcaaaatgctgaaagaaaacacctgctttcctttacctcatgaaaatatgcttcaaagtgctgtacctggtgaaaatacccttcaaaggtgaacacaaaagaaagatgctttgagtccaacaaaaccagatgttttttcctaggatacttgcagtgaaaagactatttaaaggagttctgcatggagtttgttcttttaaaagactattaaaattcaaaacatctgacaagaaaagctaatgcaaaattacctgtatcaggaatttgtaaatgggtacatcactaaagatttcataattattaaagcaatagtaagagaatattatatattactactttgtgctataaattagaaaatattgatgaaatggtcaaaatcttagaaaaatgtaacgtgctaaacttacataggagagagtagtagaaaatctcaatcacctataatttatatcttttccttaaaagaaatgccagggccttatggcttcaccatgaaacctcccaaacatttaaggaagaaataatgtcaatcttacgtaaattcagagactaggaaagaggtcagcatagctttgatccctaatagttgcaagaacattaatagacaagaaaattaaaaggtctttctcacgaacctctttgcaaaaatcctgaacaaaatcttggaaaaccttattcagagacacatgaaaaagatcatgtcatgttgggtttattccaggaatggaaggtggttaatattgaagccaaccagagtaattcaccacattaacaaaggtataaaaagaatatggttggccaggtacaatggcttatgcctgtaatcccagcactttgggaggccaaggtaggtggatcactggaggccaggagttcaagaccactctggtcaccatggcgaaaccccatctctactaaaaatacaaaaattagctgggcgtggtggtgcacgcctgtaacccccagctacttgggaggctgaggcacaagaatggcttaaatccaggaggcggaggttgcagtcacctgagatcattgccattccactcctgggcgacagagtaagactctatctcaaaaaaaaaaaaaaaaagcatatggtcatcttagtaggtggtggcaggaaaatgtagtcgataaagattaatatctttcttgatggaaattcttagaaaagtaggaatagaagggaaagtctttaatctgataaagggtctgtattatatatctacagcaaacatcatacttaatggtgaaatatcggatgctttcccacaggattgtgaatgggataggaatgccccatattgtcacttttgttcagccaacttcaaaagcaagatttaaaactacttttgaaaactgtataccacgaccattatatttttgtgggatgtggatacatggaattgtgtttaatatgctatgaagtagagcctctaagagaaaataatgttctggaaagcctcagaatggccctgcacaggcaaatgtaccaggttgttcattgcagcattgttcctaatatcaatatcaacatgaatatcaatagagaatcagtaaaataaattatggtaatgaaaatagctaagatctactgaatgcttactatctgctgggctgtgttttgattgttctaactggatttaactcatttaatcctcccataaccctttgaggtaagtacgtttagtatcgttgccattttataaataaagaaaataaggcacagaaaattaagtaacccagagtctcacaggtgggtggtgccatctgtccccagagccacttacttggcctcttgtggcacttctcagaggaagctgccaagatggtgggtgatggtgggtatagaatgacttctaagatacagtaagtgaaagaagcaaaatggtgtacaaaacaatataatgctatgataacagttgtgtttttagaaaaacagagggtgtttttcaaggtttttccttgaataatatcatgcttacttgcattctgaaatgcttttttaaatggcagtaaaaaaaatacaccatgaaatctactctattaacaaatttttaagtattgttaactagaagcacaatattgtatggcaggtctctagaaaaatttttttttaaatttttaattttatttcagattcagggtgtacatgtacagatttgttacatggatatattgtgggatgctgaggtttggggtatgattgatcccatcacccaagtagtgagcatagtacccaacaggttttcagtgcttgcctccccctcctctagcactccccagtgtctcttgttgccatctttctgtcctctagaactttgttatcttgcctgactgaaactctgtatccacggaacaattccccacttcccctccctgaggcctctgggagccaccactccactgtctgcttctgtgattttgactactttagattcctcacgtacatagagttatgccgctcttgtccttcagtgactggtgtatttgacttagcataatgtctccaaaactcatttatgttgtagcatgggacaggatttccttcttttttaaggctgaataatattccattgtatattctataccacattttcttcgtccattcatctggtggtggacactggggttgcttccacgtcttggctgttgtgaattatgctgcaatgagcaagagagtgcaagtatctctttgagatcctgttttcaattttcttggataaatacctagaagtggtgttgctggatcatttggtagtactatttctaattttttgaggaacctccatactgttctgcgtaatggctgcaccattgtacattcccactaacagtacacaggagtttcattttctctacctcctcaccaatacttgttctttttcagttttttttttttgatgatggtcttcctaataaatgtgaggtggcgtgtcactgtggttttggtttgcatttccctgatgattagtgatgttgagcatcttttcatatacctattaaccattaaaaatagaatacttatacacacatccttgaatatacatagaacattccaggaaagatattcacaaagccaattaataatgattgcccttggagagaagaactgggagatgggaaggaaaaggagactttctcttcattatttgcccttttcattgcttttggggatagtgtctattgcatgtattacctattcaaataaatgagttaattaaaaactcccctggttattccactgtgtttaagaactgttgcacacacacgcatgcacacacacacatctgtgtttgtgctattcttgatgttatgagctcaccgtgctggtgtccccctggtttttacagaggcattcgacttacagcagtgtgcggccagccagcagaggggtgactcaacgcttggaccttcctgaccttcccctctcaggtaaattatgtcaacataaagaacttttgacttatctttccgtgcagttaacttttcttcatttctctgcatgaaactgagcttagaaaaataatcagtggcatttcttgcaagtgatttcaaccccgaataatgtacatatcatgaatgttagatgcagcagtgcagctgacaaaaggaaaaagtgtctcctgccagctgcacttctcagtgcccttgtgctggggagacaggcccaattttttttttcttttccttttttcagagacatggtcttgctttgtttcccaggctggtctcaaactcctggtctcaagtgatcctcctgcctcggcctcccacagtgctgggattataggtgtgagccactgtgcctggcatattgttttttaactgaacctcaagagcatattttctaatctttaaaaagtaactaagggaaaaaatcttacctgattttgaatttgtctgctacttctgcaattcttaaaatttgcccctttaaaggtatttgtcttttggtgcagtcctcttcctgttgttacaccgtgtgtgtgtgtgtgtgtgtgtgtgtgtgtgtgtgtgtgtgtatttgttttttgttttaactccaatcctggttgtaaagtggaggttgcattcagcagtcccagcagtccccatccatcacatttgcgtggcgtcatatttcctgtgtcacaggctgatgtgaagcagccctcaagaagggacacgtgggcttgagtctcagtactgctgctcagcctggctttggccccatcaccccacttctctgtgctttagtctcctcatctctaaaacggaaataatccggtccacttcctaggattgtatcaaggattgagttagcacattaaagcgccttgaacatgctgggtgtgtggcaagcactgtggaagtgtttactgtgcacatctcacctgctgttctctgctgacccagttcgcctgcccagaactaaagggacaacagtgctcaagcctagtgggaagttaaggttgtccagaatacggggcttagaacctatgtatgtgtctatgtggtgactgttaggaaataaaaaaggcaaaaagaacactgaatggactgtttactggtccctgtagaagggatagaaagccaaaagtctgggtcacatggacagaaatccttttgtttctaagcataaaataaaatttctacagctgtacttcctttagatcttggtcaaacacaatcaggcttgttcttaaaatagttgtttctatgagggaactttcccctctgaatcttctttgctttttcatggaattaaataaggattttagagttgggtaaacactgacaattgagaatttgaagatgatctgagcccattcctcgagttttacatgggagagattcaagccctacagaaattgagtgacttataaaggctacagcgattttggatggctgtggggccaggaagtctcctgattctttctaccatgtgcctcttggtgctgaggctggtgattgctcgagtaatagctttctaaagtggtgaaagtttacgtgggactccaagtcatgatagtgacttcccagcagaaggaaatgaagaccaaaggccagtgtaaagtcaagagtgtaagaacaaacagagttcagtggaggtagagaaatgagagagtacgtgctccaggagaccaggcctgagtgtcccatactaggaggggagtggaggagaccagagcacagcaggaagcccacttggctcaccatctccgtgcttgctgtgtagcacaaaagagggaataatttgatgacacgcatagtgctaggtgtggggtttttgaaaaattgtggtaaaagacacataatataaaatttaccttatcaaccatttttaagtgaactaggtaagcctttggtagataatatttgttcttctctctgttccactagccttaaagttttctattgtgtagagacaccattctttctggttttctttgagagagagtcttgctgtcacacaggcaggagtgcagtggcattatcatagctcactacagcctcaaacatctggcctcaaatgatcctcctgcttcagccttcaagtggctgggactagaggtgcatgtcaccatgcctggctaattacaaaaattttgtggggggatagagacagggtctcactaagttgcccaggctggtcttgaactcctggcctcaagcaatcctcttgccttggcctcccaaagcgctgggattacagttatgagccatcatgcctggccaagaaaccattcttttttttttttgagatgcagtcttgctctgtcacccaggctggagtgcagtggcgtgagctcggctcactgcaatctctgcctcccaggttcacaccattctcctgcctcagcctcccgagtagctgggactacaggcgcctgccaccatgcccggctaattttttgtatttttagtagagatggggtttcaccgtgttagccaggatggtctcgatctcctgacctcgtaatccacccacctcggcctcccaaagtgctgggattacaggcatgagccactgcacccggccaaaaccattcttttagttgacacggtacatactgaacttgagaccacaatagcttattgctctgcagttaatatctcattgacagccctccctacttagcccccaccaggcacctgtctgcttggatgattatatttactgttattacagcaaaggattacagtgacaattacttgcttctagcaatccccaggaattgcttgtcaacactgaggtcattggaagctgcagaaaccaaagattaatgtgctgttcttgttgttcccttggatgtaaatactgtttttctctgctatttagagctgactagcctcactcccaactttactgcccctaattggtggcagtgagctgtggaaggattactttcttctgtgactattcacaggtcatgggcggcaactgtgggctcatcctggtccctggtctgctctgtagcttagaacaaggcacttagttctctgagctccagtttcctctataaatataaactagacagtctcgaaagatgtctcctgttccgcacttttatggtcctttgagaaatatagtctggctagacatggtggtgcactttcctgtagtcccagctacttgggaggctgagacagaggatcattaggaggtcaagtccaaatccagcctgggcaacacggcaagaccctgtctctagaagagaaaaagaaaaacaagtatcatctggaggattcagttcatttcattacctgttttttgactcagactaatatgacagcagaaaggagccttgaaagagtgattcctacttcttgtttagcaagccaggccctatggctagaatggccttttctcttgtcaagtagttcttcttggttcccagcttcttgtttattgctgcctgtggtctgatcatcacttgaggcattttcctgccactctctctcagatgtctgtcagttaaaacaaaagatactacctggggacagggctggcttcgttggcacttgcacaaggcccttagaaggacacatgcttggtgtaatgctctgatgacatcatcttgaaattcacagtgatttttgagcaggaggttgatttggtgctagatgctgtaaatgatgtagtggtcctgcctgtagaatccacatccctattgcatttttattacttcagaaactatatatatgtttgcacttgaggataaaatgagaactgtattgtatttgagaatgaagtatgatggcagtcaagagctgcttctttgggaatgagtgattatgtggttgttcccacagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcaggtatcgtgtttcaaacaataagaaatcagaaaaacatcgggctaatcaccttttattcttccttccgttttgtccccgtggccaatttacttctacaaatatttcctgcatgaaaatgactaagacactgtgcctgcccttggtgagtctaaaaggatgacagtggatagtagtagtgcgcaaaatggaattaagggctgtaaaaaacaatactgcataagcaaagtcttgagaggttgttagttggatcaagaagtctagagagaagtggtgtttctgccaagggctctaaaggtaccattacaagcacgctgtggaatagtgatcagggaatgtgggtggtgtcatgtgtctgaactagtctgtgggcttcctgagagccgggactctgctgtacatatgcataacaagctctctgtcagtatttgttgggtggatggataagtgactaggacattccatctggagggcatattgtaagtagtcttcattgctaaggaagaggtttgtgcattattttggtaaagcactggagtaccaccaagtttgtgggattttgtttcggattttgaggttgtacagtgagattggacctgcattttaaggaggattcatcagaaaacagtggtatataaggattgaagaggcattttgaaatcagtgtttaagaaggactgtcacagggatgtaaaggaatggttggcagagggagaggatggcaagaccagcagggtggtcactaagagcttgtctttgttcccacacctctgtcacctcctccctttccagtgcccctggtcgcccaggccacagcaaacctctttcagctgcttcctctccccttgtgacttccctgcttctctgtgttggttaattttctgatgcactgagcacatcctgctgcagaccttgcagaaatctcacatgactctgtcatctgcactcctcatcctggtcttctagatgccccacaacttagcaccaccccacccacctgccagaatggccctgttcctccctccacctgagcctgttttagtttctgcctttgtaatagaacatgaccatgtctgattgcaagtctttatgtataaggttctagcctgaatcgtttttcttttctcctttcatactccaaatactgcttctccttcaaggtcaaacctttcatgaagttgtacctaacacctggcacattgacatatcccttctctgactttggcgtcttacacttttttgggtgtttagtttttgtactgctttgtagtgtggaacactgttgcacagtacatgccattgtctccatttatgctataatttagttgacagtaaaagttcaacttacattttggtatctcttccagccccttgcattgtgcaacacacatagcatttcacttagtaaaacttacgagtgagtagatggattaatatacaaaattggctagtttaggagtaatagctttttaataaatcttataatcacaaatatgggtattatagaaggatttataaaagtctgaataaattcaggtcttgttacacctttgggtacagcatatatttggacccaaatagatgaagtcatgtgtttcagaagtttaatgtaaagccccagatactacatattgtcctgtttatgtgcaagagatttaaataatcaaaagaggttttaaggaccagaattagtgctgttctgaagttgccgttttctttatgccagaaatgcatacaaaaaggctatatgtatatgaatatgctattgatattttaccttttttaatgaaaagttaaattagtaaaattcttatttcaattttacacttacgttattgacataaacaatggcaagatatttggtgtttttaatatgcccttccaatgcacctttaaaatttattttattttattttttggagatggggtcttgctctgttgcccgggctgtagtgaagtggcacagtcatagtgcactacaaccctgaactcctggcctcaagcagtcctcccttctcagcctcctgagtagctgggattagagatgcacaccaccatgcccagctaatttttttattttttatttttttaaagatggggtctcgctatgttgcccaggctggtcttgaactcttgggctcaagagatcttcttcccttggctcgtaaagttctgggattatagatgtgggccactgcacccagccaatctaccttttacatgttatttaggtactggtttagtcttgaaacatgtagggtgtgttttgtttacgtatctttaattcaaatgatactgtacttaagtaaacaaatgaaagactagatggatgagcaacaaatggatttgaaaacaaaatgtaacaaaactctccccaaatttatgatagtcaggaagcacaatttaatttttattttatactgtgagatatcacaaaatagtaatgtgactaattcggctgtttctttagaatcttgctggataaactagacttttgcttttctaaagtaggtatttatttcttgtgtatttgagaattctaagtattagcatcttctccttaccatgtgctcttctttctaaccagtgtggaaagaaaagaccctctggcagccttggcccgggaatacggtggttccaagcgcaatgctctactgaaatggtgccagaagaagacacaaggttatgcggtaagggacaacatcagccaacttccagctgcccctgggcagtagtagtcctgtgccaatacatgttccttgtgtgcctgtgcttgatgggccaatatgcatgtaattgtcatctttctattctcctaggcagggctgccagggaatgtttgatatttgtgcactgcccaaaggcaccgtgacagaggcaaatgcaactgaaaaacggtctgcactccacccaccaaatgtatggctgcacgcagagctgcacctcccgagggaaggggacctttttctttggtcagagtgttactggccacaggttcttgggctgtcaatgcgatagaaattgtcatgaggccaaaagagttttctcaacaaggctttattggagcttatgcccttatccctcaggcatgagggaggaagcacgggagagggaggattctctggctgactccttgaaatgagctggtagggatttttttattaagcaaagtgcaggaattgatatcaacatagagaatgtgggctgggctgggtagatcatatgaggggtaggggatgtgggtcagtttatctgctggcgacggttgtcttgagtcatgggccacctagtgttctggttggtggcagcaaggctgtaaatcagttgtttagcattcttccctgagatgaggacatttgcaactttggttggatatgttggatttcctagggccagtttctggaattatttaagtaaaagaattaaacattcttttattcttttaaacattatgagagtgcggaaaaacagtatggctattttctttgcatgactgttaagcaggtatgtcagtgaagtagtggtgtgggttttgtgatcagtgggaatgcatgaaagaatgctatagtggggatgagctgaagccaagtcctgtccctgctgtctcagaagaagacacaagctccagtggctcacgcctgtaatcctagcactttgggaggccgaggtgggcagatcacgaggtcaggagatcgagaccatcctggctaacacagtgaaaccccatctctactaaaaatacaaaaaattagccgggcgtggtggcgggcgcctgtagtcacagctactcgggaggctgaggcaggagaatggtgtgaacccgggaggcgaagcttgcagtgagccaagattgcgccactgcactccaggctgggcgacagagcaagactccgtctcaaaaaaaaaaaaaaaaaaaaagcagacacaagctccccgagcagtgatgcctccacccaagaagacagcttttgctgaattaccctcctgaagaagagtgctttgcctaattcgcataaaggtcctatgtagttgggcctccaaaacttctccaaacattttgtttctattgttttgagaattgtttgcgtttagtttaagagtttttgttttctaggacagtatctgttttctgtgaatatcagaaaagggaagtaatacctgatgtaagtttaagtttttttcttgtgaaatacacaaagataaaatgcacaaaatataaatcataatttcttgaactgtgaggaagtgaaaagtcatgcagtcaccactcccatccagaagaggagcatcaccagctcccacagacccttcctatgactttcccatcatagccctcagtactccctaagataaccattgtcctcaattctccttccagatttttacaaaagtatgcatccgtaagtactatgttagtattgcttgcatttgaattttattacaaatggaataaaaaactatgtaatatttgcagctagctttttttacacggtattgagtcagtgagatttatcctcattgttgcatatagctgtaatttgttcattttcttcaccatttagtaacccattgtaggattataccattatttatccattcgattattgatggagagttgagtcatttctagtttggagctattatgaataacgctgttatgttcttgtgcgtatttcctgaaaaacatatgtgctcattcctgctggatacatgcttaagaatggaattcctgggccatagggtatgcatacaatctagtggatagtgccaaacagatgactgaagtaattgtataatttatgtctctccagcaatttatgagagatttatttctctgcattcacatcaacacttggtattgtcagtctttttactcaaggtcatgtgggtaatgtgtagtactgtctcactgtggttttggtttgcattttcctgttggctggggaggctgaacaccttttcatatgcaaatagataccctctttaaaattggcaattcctactgcattcttaacaatattttgctaaaatttcggaagattccagcaccgtaatactcccttcccaggctgaagcttttgagggaggtggggatggaaaatgaaagaagctagcaagaaaaacccagcctcagccaagatccatcccagatagtaaattagcagggctgggagtctctgtcatgtcagcagtcagatgtcttaaaaccagaatctacccagagtatgtgtatcctgtatctttgccattaccttcttttcactttatgttaaaaaagaaaaagaatcgcagcactttgagaggccgagggggcaggattgtttgcgcccaggagtttgaggctgcagtgagctgagatagcaccactgtagtgcagtgtgggtcagaaaaaagaaaagaaaaacctgtcatgctactgaccaataatagaggctcccaaagtataaactcgcctcagacccttgtttattcttcctgctaccctgtccactctgcctctgccctgtttcaaggatggaccatgccatgaaggaaggcctcttggttacagcctcccccagcccatcagccacgctgccgaggacacgggaaagaataagaagccataagaaccaatagctatgacttcttattctttcctgtgtccttggcagcgtgactgatgggctggggaggctgtaaccaaggggccttccttcatggcagttgaacaatgtgaacacttggacacaggaaggggaacatcacacacgggggcctgttgtggggtggggggaggggggaaggatagcattaggagatatacctaatgtaaatgatgagttaatgggtgcagcacaccaacatggcacatatatacatatgtaacaaacctgcacattgtgcagatgtaccatagaacttaaagtataataaaaatatattaaaagaaaataaataaatatcaagaaggagaaagaaaaaaaaagaataagaagtcagagggaggcagctgcctgcaggaggtttagcgtaaagaaaataggaatggtgatgggaaattgaagaaaacatttaaaaagagctgtcattcaagaatgactccactgatgccgcctgtgctgttccccacctgacagtaatggaccaaggcagctgccagagtgcatatgaaaagacaattcacgttttcagaaggagtggccttctatgatgtaaccttgttgtaatgcagggaagagacagacaataagatgtttccagtcaggatcacaagaacactatttcctgctggagtgatttgtgtgtgtgtgtgtgtgtgtgaacattttggattcgttttcaaaacattttacgtttgatgaaacccaaaactcattttgcctgtagtacttttcattcatcatgaaatctctgtaaaattagaaatatgaccatgtgtctgctttatttacccttcacaaaatatgtctagacctgtttgtctgagacacctcatagtcttgttctctcagaattaggaagccaaaaataactggtgaaaactttttgaaaaccgggaaccatgtgtacttgacttaaaataactttccttttatttcatcaaaatacagcgtgaaaggttatgttacatccctccatatatatatatttttatttcagctttagttatagattcagggggtgagtgggcaggtttgttacaagggtatattgcttgatgctgaggcttgagttatgggtcccgtcacccaggtagtaagcatagtactctgtaggtaggttttcaactcaggccttcttcccttcctcccttgtctagtagtccccagtatctattgttgccatccatgtggctttttttggagacggattttttttttttttttttttttttttttttttgagacagagtctcactctgtcacccagtctggggtgcagtggcacaatctcaggtcactgcaacttccacctcccaggttctagcaattctcctgccttagcctcccaagtagctgggactacaggtgcaccccaccacacctggctaatttttgtatttttagtagagacagggtttcgccatgttggctaggctggtctcgaactcctgacctcaggtgatccgcccaccttgacctcccaaagtgctgggattacaggttcacacctgtaatatacataaagggctactggatacatatacataaaaagggccactgcacctggccctttatatccatatgtactcaacgtttagctcccacttataagtgagatgtggtatttggttttctgttcctgcgttagtttgcttagaatagtggcctccagctgcatccatgtttttgttcttttatatggacatgatttttgttcttttttatggctgtgtatttccatggtgtatatttaccacattttctttatccaacccactgttggtgggtacttaggttgattttatgttttttctactgtgaacagtgctgcaatgaacatacgagtggtagaacgacttatttttctttgggtatatacctagtcatgggattgctgggtcaaatgttctatttttagtaccttgagaaatctccaaactgctttccacaggggctgaactaattttattcccaccagcagtgtataagcatttctttttctccatggcctcgctagcgtctgctattttttggctttttaataatagcctcctggctagtgttagatggtatctcattgtggttttgattcgtatttctttgaagattagggatgttgagcgtgttttcatgtttattgaatgtatatatgtcttcttttgagaggtgactgttcatttcctttgcctattttttaatggggttatttggtttttgcttgtggatttaagttcttatagattctggatattagatgcatagtttgtgaatatttcttcccattctatgggttgtctgttaactctgttgatagcttcttttgctgtgaaggaactctttagtttagttagattccacttgtcaattttttattttgctgcacttgcttttggggacttagccaaaaattctttgctaaggccaatgttgaaaaagttatttcctaggttttcttctaggatttttatagttcgaagtcttatatttaaatctgtaatccattttaagttaatttttatatgtagtgacaggtagaggtctagtttctatcttctgcgtatggtcagccagtcatcccagcagcatttgctgaatagggaattctcttcccattgcttgtttttgtcaaagatcagatgattataggtttgcagctctatttctggatactctaacttgtgtatgtgtctgtttttataccagtgccatgctgttttggttactgtagccttagaatataacatgaactcaggcaatgcgagtctccagctttgatcttcttacttaagattgctttggctattcagactctgttttggttccatatgaattttagaatagttttttctaattctttgaaaaatgacatttgtagtttgataggaataccattgaatctgtaaagtgctttgggcagtatagccatttgaatgatactgatttttccaatccatgagcatggaatgtttctccatttatttgtgtcatagctggtttctttcagcctccttccatatattgttcagctccaggtaatattgtaggtgctgggggccgggcgcggtgactcacgcctgtaatcccagcactttgggaggctgaggcgggtggatcacaaggtcgggagatcgacaccatcctggctaacatggtgaaaccccgtctctactaaaaaatacaaaaaattagccgggcgtggtggcacgcacctgtggtcccagctgctcgggaggctgaggtaggggaatggcgtgaacccgggaggcggagcttgcggtgagccgagatagcgccactgcactccagcctgggcgacagagcaagactccgtctcaaaaaatatatatatatattgtaggtcctggggattccacagtgaatgaaacaggcaacagtccctgctctcatggaacttaaatcctcatggggtctggcagttaactgaaataaaaggtaacatatgtacggtatttgaaggttgtattgccgtggagagaaataaagcagggaaggagggttgggaatgttgggtgaatggtacaatttatacatagtggtcagggagatgacatttgagcacttgctcccctctcttgaagggctttggtgtctgcatgaagctttatttcccaccaaggcctaggtgtggagggtcagagtaaggaggtcattactgtcgttactgtgccaatagaagctgaagtgacacacggtggtcgacccaggtcagcagcactgggaagtgagcatcgcagccagacccacctgccgagctccgggccaactgcctgacatctcgagtggcccaggattgagacccagtgaaaggatgtgagtttgccctcactacgaagtgaggcccagttcactaagctcaaaatggcgctcctaggaggcccttcctcacattctgctcaactcatacacactggtgtctttttggaataagtcactcctggaaaggccctctaaattactctcagtcctcaaatttcatactcctgatgtgtgttggctgttttccaagccaagggcaggcctgactcagataactcctacccctccctttctttcatctgaaagtctagtttaagctcctagttttctgttacgatggagagatttccatttgtaatttccagtaagaattctgaagggacagaaagtcgggagggtaggtgtgacaggaagaattctgaagataacccccatgactctccatggtagaatgtcctcctctttatatgacacagggagatggtctggatatgcccactaatcacaaacccctgtagaagccaagtgatgtctctggcttgtggcagaagttggggaaattcaaagcatgagaaggactctgattgttcttggtggtttgaagagggagggggcacgtgagaaggagccaagaagggccccctggctggcagccagcaggaaacagggactttctagcactaaagcattagtgctgaggtcctggccgtgcccagaaattgccatgtgggtgctctggagttttgaggttgacaactgcaagttgtgtgtagtgccaccgggtcctttgtctcctcctctgtcctgatgccctcagacctcagccaggccagggacgctcagtttgctttgccttctgctttccctcagctgggggatcttgggctggaagtcactctgatgaacatgtggaattcagctctaagtctctcctgagtcctctgttacctcccaggaggcatgatgaggcacagctacccttcacctccatgggtggcatgaagatacttgcaagtatcttttagacgaaaatatataccggtatttactgttacttgaattcctgtttggttcttgcatttcagatcaaaagaaagaagagtttagatagggatttacttgaaaatgtatctgtatctgttccacttttgaaattgtatggcaagaattcagatagcaggcgacacctacactatcattaagggacagatgacgtctttgaaccaggttttaacctgttagctcagacctatatcttcttctcttttggagaaaaaaaaatcagtctttgtgtgtccacactgaattttgctttgaatctggaaagaacacccatgttgcaggcaacttctgttgttctgtctctgagttcccacaaacaagcactaaaatctgcttagccaatagcaagcagcctctaaaatatcaggtcacttggggctctgtttcttatattcttttttgagacagatctcttgaaggctacacgcacaattcaaagaacataaagcctttgatttatttactgccatcagagtggtcctttccctgacttagatgatagagtctcaatagcagatgcgcggcactgtgggcttccactctattgaggccttttctacccactttctctgcttctgtaccgtttctgacacagtggtctgtgaagacattttcagtggcacaggtgttgtcctacaacctgtgacaacagtggagtttgtttgcaaaataaagatgcaaggctttcccatgttgtgggagacacagtcctctcctggtggccgtgtttctggttggttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggctcaccacaacctccgctcccgggttcaagattctcctgcctcagtctcccgagtagctgggattacaggcatgtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataaatctgtgaatagccgtggccatgactccatgctgcgtcctgtgggtccttcccctgatcattgaacacgggctttttattgagccttaaaaaggagtaaggcactgacacaggctgcagtatgaatgttccctgaagacgtgttgccaggtgaaagagctgggtgcaaaatctacatcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcaggaggactgctgagaccaggagttcaacaccagcctgggcaacatagcaaggccctgtctttaccaaaaaaaaaaaaaaaaaaaaaaaaaaaaaaaaaacattagccggctacgatggtgtacacctgtgattccagctattcaggaggctgaagacagagacttacttgagcccagaagttcaaggcctccgtgagctatgatcacaccactgcactccagcctgggcaacagagagagaccctgtctctggggaaaaaaaaaaaaagtgtgccatgatgatgaatatcacttaccatgcatttttatgcttatgctaaatagttgtgaaatagtgccaaatttttgtaaagtaagttcctagaagtgaatttgtttttgcaaaagggtgtgttacactttccattttaatatatattctcaaattgccttcattaaggttatttagtttacacttctctatacagtgtacaagattatacattcccaatactggatacacctactcttttgatctttttcagcctaagaggagaaaatggcatttcttttaatttttcattgcagatgaaggagaagcactttttatcaacttgttagttatttatatctttcttctgtgaattactactacagttgctttgcttgcttttctatttgtatgttcatcttttttcctcaaaatttgtgatagctctttttggttttcttttggtttttatttttatcaaagctctgcatgcccacaatcaggtatgcagagatcctgatgagcaaagcagtcagccggcctgagagctctgcttcctgctccccagagtcaagcattttcaagtcaccttgctgattttttttttgtcatttacctctacgttgctgactagcacgtttatcaactgctatttctagtttttcattttagatgttgtattttgatctcctactgtgaaagatgagggtttatttctttttcactcccaccccccccatgcttcctgtctttgcattctttcatggttgtacatatctggagttcacattaagatgctgtgagtgtcattcatagattagccatgtagtagtatacactgctgcagctttttcttttacacaacctgttacttgccttacacttaaaatcgtcttgtttttgtctgtttacttagttttgtatgtaaatgatactcattcaaccgcaactcttcatgagatatccccacacatcacaagggtcaggggttgcagctgtgttatcctgaggagatctctctggagcctctgacctcttccatcatggctgccctctatgcctggtgcacagagtccctgttagttctttgcctctctcttttttgatcttctgtatcctacatcctattcttttttttcccctttgtttttttttccctttgtttttttttcccttcagtatctccctgagaatgagttcatagatggtaaaattttatgacctcgcatctttgttttaccctgatgcttgatggtttctttaggtataagattttaggtcagaaattattttcattcataattttgtgggcatcgctccattgtcttctatttgccagtgttgcagcaagaaaagaatgattacagtcgtttgtgatttttttttcctctgcaaaagctcataggaggttctggttgtctccaggattctaaaatttcagggtgatgtgccttgctctatagcttaagttttgtgttttctatcatgctaggcactcactgcaccctttcaatatgtaattcatgactttattttctggaattatttcattggtaatttcttctactctgttttctttttctggaaatccccctggcctggccctctaattatcatattctttttttcccctatttctatctctttgcattacagttttgttttctgggaggcttccctaactttaatcttccaaattctattaaatgcttaattttgcatttttttttttgcttttgcatcatttcaattgttttttaattgtgaaatgtacataggataaaatttaccatcttaactatttttaaatgtacagttcagtatcgttgagtatgttctcattattgtgtaaccaatctctagaatgttttcattttgcaaaacttaaattctatacccattaaacactaatctgacattcccctcttcccccagcctctggcagcagccattctactttgtatcactatgaatttaaccactttaggtaccccatataaacggaatcatacagtatttgtccttttgtgtctggcatatttcacttagcatgatgtcctcaaggttcatccatgttatagcatgtgtcaaaatttccttcctttttaagactgaataaaattccgttgattatatttgctatcatatttttaacttctaggatttcttttttattccctgaaattttttatagcatcctgttcttgtttcacagatacaatgttacatatgaatttcactgaggattgtaggttgattttatcaccaaatctctctatgcagattgtttcctacagtccctttattccattggtatctttaggtctctatctttatgctggaggtttgactgctcatgtttaggtggaggctctgcaaagctgaccccctccctggcctgcgtatgaggcctgcgactatgttcctgtggcatatccatgacgaacttctggtgtcagtgtctttaggtggtccttcctcttgggcacatccattctccagagaaaggccttctagtctcctgctggaggacatcaacctggcaaccagaattgtgggacctaatcagaaaagaggcctgtgggccaggcacagtggctcacccctgtagtcccagcactttgggaggccgaggtgggtggattgcttgaggccaggagttcaagaccaggctggccaacatggtgaaacctcatctctactaaaaacattagtggggcatggtggtgcacgcctgtagtcccaactgcttgggaggctgaggcatgagagtctcttgaacctgggaggcggaggcgagatcgtgccactgcattccagcctgggtgacacagcgagactctgtcaaaaaaaaaaaaagaagaggcctgggggtggagagtgactacctcagccctcaccatgtaaattcacttaattcccttgttttcactgcatcactcatgcctccactgctcactgtcctctgggtgtgcacagaagagagaacgtttggagctttggctgctctataaacagatctccaacccattcttcctgtttttaaccaccttcattcccccacctgaagcacctcttgccaccaatttcctgtgtctttgagggattttgcaccataaatcaggttgggtctttgcccttcgccactgctggcctgggatttagtttgcttcggtctgttatgttagttatctcttgtccattgacttttcagctgccaatgttttgtctttttgctttctttcatgttccctttttccttgtctgttaatgcctttggaggaaaaattcctttctgtggttttctggggcttcacgagggggtgagattgtgaatgcatgcgtttcattgccatcagcctggaggcctcagagagctttattcctttctccttaaggatattaaccattatctgtcatagaggttccaagtaccctttacatatatactatattatatacaaatacacacacccttttgttccttctggagtgcatttgtgtttgttaggtcaagttttatttttcccccagatggatggctatttatttcagcatcacttatttcatcatctctcttgaactaactgataggcctaggtatgaatgggaactgagtggtgtctggacttgctgttcccttctgtgcctctgtgggtctggcctctgccacaggttgctgccgagcagagaaatgagagcaggacctgagtgcggcacagcgccctgggcctcagccagggtcctgtgagtgtcagtcagtgctgtggcatgcgttgttttgatgaatttaatgccctggcatttttcattatttgattatacttgttggttttctaggtaaactattacacataacaatagttttgtttcctttttttcttttttcttttttttttttttttttgagaggtagtctcaaaaaagtctcggctcactgcaatctccgcctcccaggttcaagtgattctcctgcctcagcctccctagtagctgggattacaagcacgtgccaccacacctggctaattttttgtgtttttagtagagacgaggtttcaccacattagccaggatggtcttgatctcctgaccttgtgatccacctgccttggcttcccaaagtgctaggattacacacatgagccactgtgcccagccttgtttcttctaatatttatacctcttgtactttttttggtttattgcattcatgaaagtccaggtcactgttgaataatgctattgatggtggatattcttgttttattttctgttcgtaataacagaaataagatttaataatattattaaataatttaataataatttaataatcacctaaatgagattcttgtattgttttgtgataaatactctatcaactaaaggaagcttgcatctgttttgagcttaccgggggatgttttaagtccagaaataggtaagaattatatcaaattcctttttagcttttaatgagctatccatatggtttcttctcttttgacccatttatgtaattaataacataaatacatttactagtaggggaacatttgtacatatctgggggcaaaattccaacttggtcatggtatactattcctgaaggaaactctacttgattgtggttattctttaatgtgaaatatacgattttttatactcagttattgatgagacatttggcttcttgttggttgctttggtataaatgaagttttgtctcaataaggcctgtttttgtttttgttatgatgttagtgagctctaaaaccctgtatcatctgtatatagtaaaaagtgcaataggtatttattttaccaccttctgtagtaggattaatgacagaattaattcttagccaaagagaatgttttatactctagttgcaaagttctgtccagtctgacaaatgaaaacctgaaaaccccaaaaatgttgttgggtagaagttgggaaacctttcatttaagcttcagacaatttttgtgaaaagtataagagtgaagacttaacatttttcctggaactgatgctcttttgttttgatgaaagtcctctgaaaggacttgttagttgcatagaggtaaggctaggcccctgcctattctcagggctcaaggcctgagcagccgaaggcccatcagtggtcccagttacctcagtgggagctcaagtgtcccctgtccccatgtggccacttgatctgctggattctgagtcaggtgtgttgaaatctcttactctgactgtggtttgtgtcaaaagctttgattgctgagagattatgttccagatattttgaaccatacgtaaaggtttcttgttctatcttcttggtggtttttaccttttacttcagttaatccttttgatctagaagcttacattttatataccaatattgctatttccatttatgttttctgtgcattttatgttttgcatttatgttatttgcatgatatatctttgtactttctttcctttcttctctttttttcccccagagttggagtcttgctctgttgcccaggctagagtgtagtggcacaatcatagctcactgcagcctccacctcctgggctcaagcaatcctcttttcttagcctcctaagtagctgggtctacaggtacatgacaccacacctggctaattctttaaaaaatttttttagagacagggtgttgctatgttgcccaggctgattttgaactcctgggctgaagagatcctcccacattagtctccccacttagctgggattacaagtgtggagccactttgcccagctcctttattttcagcctttcttagttggttgtttcagggttatgtcttataaatagtttggctttacatgtaatctgaaaattcctctaacagggcagcttagcctgttcacattttcttgtggctgtatgtgttttatcttcttcctctgtctcactttctatttttagtagacttctcttgctggcttccttcttactgattcccaggcacctagcagcgtggtaaggtgtgtgagttgaagaggtggaaaaacccaggcctgagactctgaggggtaaccacagtggaataatcataaagtttaaagctagagtctgtttttgttaaactggagcagaatcataaatcaaacacattttaaaaaatgcagagctacagagccggctgcattagtgagaaacagccccgtcggcccctttggggtcagaagtcagaattggaggcagggcctgggcccagttgctcttgccagggctgctttctggggtagaatggaggaagagccatgggcaagggccaagtccactggccactgtcaccaggggagcagcccgaagtcagggccgtacctgggaacaagaaggactccaaagacctggagcagatctggagcactgtgagttggaggagtcgggctcggatagcagcctgcaagggtgagggtgctgagaaagcaagatggacagagagggacagatgtggcccattcagggatccagaccagtgtctcatggcatctgatgtctagtcaccagcatgcatggggacatgcctggacacttgggctgatgcttctgcatgactgagcctcacggtagcagggtgcccctggacagaaacaaccacatgaccaagcagaactccttagcagccatttaaaaggataactggaaactctccaacctaattgggtaagatggcttaccaatttgctaagtagggcatatgcttaaagtactttttaaactttttttttaaaatgatgctgctaaatgaaagtatgtttaatttcacagggaggatctgtttttgccaaatgaagttcacttagctccttttattggtgctttggggaagagggggtgtggtctgtccctttagccttatagttcttgatctggtttttctttttttcttttttattgtaaaatacacataacatgaaatttatcattttaactattttaagtgtacagttcaggggcatgaagcacgttcacatggttgtgcaaccatcactgctttctatttccgaaatgttttcatcatcccaaactgagctctgtatgctttaaacacggggtaggggactccatattccccgccctcagcgcctaaccaccgttccgcttcgtctctgaatttacccattctagccaccttgtagacgtggacttacacagaatgtgccctttgatgaggggctgatttcactcagcacagcgtcctcaggcccacttatgttgtggcgtgtgtcagccacgctgcttctgcatccatctgtccaccttctcctctccatagtccccaccccatcctgggtcaggagttgtgatttttccttgtgtcttccagaaccaaagctgggagatcgcctgctaccatggcttgaaaacccttaacgactctgcagccagcagagttggacccatattcctggcctgtgtgaaagaccggctttttttaatgggactatttagctgtattatttgtcctcccttttctcagaggtatggaacatagctcccctccccaccctcaccacacctacctgaaaaacgggaagattagatccaccatgtccttaaggaaaagaagagagtgttttgattgccaacaatttgggctccaggcttctgtaagtcatcaaggtccatattggagaattagaagcaagagggtaacagaggcagaggataagagcagaggcttaggttgagggagagcagaggccagcgcccttggatgtggtggccgggggctgagaggtggaactgggaagactggaaactcagccaccctacaggctaagggcccacatcctccctcttctgacctgccaaattcctacaacatgcaggagaaagtgagggaactaataaggtgagcttattaatctggttaaaggttcttggctgggcacagtagctcacacctgtaatgtcaacactttggaaggttgatgcaggaagatcacttgagtatagaagtttgaggctgcagtgagctatgattgtgtcactgcattccagcctgggtgacagagtgagaccctgtctctctctctctctctctctttttttttttaaaggttcttaccatgagttagcctcgtcttctgacttcccagggtcatttgaaggaagcatctgcatcaaaactgccaatttacactttaaaattttttatataaatgttagatgttttgccagcttcaggaaggaaaaacaggattttcaaaataaaatgttataagaatgtgtcatcctcctggggactgagggtgatttaagtcccttggtcttctttcctcccatgggctgtttgtccccagctgagggcctccatgggtcaagtatgccagcagctgctgctgcagcataacactgcccaacaccaaagccatcatcttgtcaccattcagaaaaaggaggccttgatttttgctgctgttccttctccatcccccaggacagcatgtgagtctatttagataatcacagtcccaggtgaatctgcactgagcattttttccattctcttactcgtgaaatgttcatttgggaaaaagaagtaatttcatggcaagacacttatgatttcacaggctgaattcagtctttctgagggtagaaggttaacggagttgaaggttacttttctttctttttttttttttcttttttttttttttctgagatggagtttctcccttgttgcccaggctggagtgcaatggtgcgatctcagctcactgcaacctctgccccctgggttcaagcgattctcctgcctcagcctcccgagtagctgggattgcaggcatgcgccaccatgcccggctaattttgtatttttagtagagaaagggtttctccatgttggtcaggctgatcttgaactcccgacctcaggtgatccgcctgccttggcctcccaaagtgttgggattacaggtatgagccaccgcgcccagccttgaaggttacttttctagtataaactaaacttgatcttggaacaaaattccttataatcaatttttcagttattgcatattattttcttagtacaattctaattctgctgactacagagtcagaaagggtttaaaaaccatggtgacaggtggtctcccagccagagctgtggttttggaagacatgaggaagaccacaactcctgaactaggatgggggttgggatatggagaggagaaggtggacagatggatgcagaagcagagtggctgacacacgctgcaacacagatgggtctgaggatgcttcagtgagtgaaatcagcccatcaccaaagggcacgtgctgtgtggtggaggaacatagtcgcatgtgtgttgttgggaggtggagtttaaggtggaagaacctctttgagggcaatttggcagaatccatcaaaatggattccacctgtgtgcagagaggtgcatgggaggacaattatcgcagtactgtttgtgataacagaaaactggaaacaacctaaacgggctgctgtctccatccatgtgatggacctgcatgtgtcgtcagagaacaaagtagcgaatggtgatggaagtaaagctagcagtgacaaaatatttaccacgtgaccgacattgtctaagtgcatctaatcttgaccacaatctcatgagttaggcattttgtatccattttacaaatacaaaactaaggcagcaagaggctccatgactgctcagagtcacaccctagtaagggatagagctgggactgaactcctgctgttgggcccagcatccagtcccttggtctctacactgaaactgttcatccagatgtcgtgaaggacctagctctatatatcttggtaagggtgcagaacatgccaccatctgcataaaagggggaaatacacatgcatgtttgcataagtgcaagacagcactgtcctgtagaaccctctgtgatgatgggaatgttctatatctgtgctggccaatcctgtagccacaggtggctgctgagcacttaaaagattcctaatgtgactgagaaatggaattttgatattatttaattttaactaatttaaacagccacatggggctggtggctgtcgtatggggcaatgcaaggtagaatatagacagatggatgttaaagaaaagatcaccggattttgtggtttgcaatccctacttttaaaaaaccttctgcagaagcatcattggaagaacgggtttcataactgtttatttcagaaccactaatttaatctagccacttcatttgagagatgaggaaacttaaggcagaaaagttgagtcactttcctaaagtcatattcagctgcgttagtgtgaggaggaaggagcgggtcacagtttggtttggtttgttcctctttagagcatcggacattctcgtttgccaggggcttcattcaatctgatgtcagctcagttcttagcatggccggtcggttcctggaaatggcggctttgggtgaaaccatgtgctgtaagccatgggaactcaactctggcccatgtcaattagcctgcggtgaaactggttttgttatacagcgtgtcaccatttcacttaatgttacagtgtccaagaacctcccaacattaagtgaggacttactataaaagaaagaaagaaccagacttttgtctcctgggctcccagaactccatgaggaatcttgcagtggctcgccctttcctgaagccccagagttcatcctgcctcctgcacaccccaggctcaggctgtcctgcctgcctgcaccacagcatgggtgaaccatggtaggaccatgcttccctgcggtgtactcctcagcgcctcacacatggagggctttggaaatgtttgtgtggactctactcccagcctcgagggctgaaccgctagtgagttgtgcagatggctcatgaggagatttctccaacatttccttgagggagctgctggacacaggtaaacactcagcaaggagcagaatggggcttcagggggctgctagtccactgagcctgggtgactccaggaggagaggagccagcagagctatgcatgaccatgaccttttttagaagcagcaagcaaggaggaagagtggaattaatgaaaatgaggtagccaacttaacagaaaggcagaagaggaaagaaaattccagggaagtgtttccccagaggcctgagcatggtcctaggggtcagaagatggcagggaatcatctgggatccgaggtgagggcacagagaagacctgttctcaggacgccaaggaagaactgggaggcccctgctgagccgcggggcttcgcctgcgttcgggtgctgtgtgaggctagcactgccagtggaactgctgttgggctggaggaagtggacccagccagggggcaggaggtgttggccgcaggcccatgcttgcaaggcaaccagaccctgtgtcacaatgccaaagccagttaacctcggggaagaaacgccgtgggtggggacttctgagtgtttgtcaagtgaaaatggaggaagcaagaaagacagggccccagctgctcctgagatgtgtatcttctgtgattctgtctccagggagggactgtgcagcatctgcctgaacatctctgggacacagccgtcctctcgccataggaaggctcttgtccacagaggagtaaagggaagggcgctgcttcctgcaccagctcaccgtggccgctgtctccattttcgcagtctcaaaccctcggtgctttcagtgtggataaaagagtgggaggaacatttaaaaagtgaattattccaaattagtctctaaatttaatgcaattccgattaaaatcccaacagactttctttattcttgaacttaacaaagtaattaaaaattcacctggaagaataagcaactaagaagagccaaaaaagtttagagaaagagtgctgatgaaagtgggttgccctgcctgactggaaaggtgcaatgaagccacggcagaggagacccccttcacacgtcattctgcccaccgtagcgttgcagaagcaaagacacagtggaaacagccatgagcatggcccctgcagctcatgtttcagaatagtaatgacactgacttgaacgggttgaggaggtctgcatttttttaaatcttaaaagataagtagaagttgtcagatttgatttgggagataatgagccatataaaatctaaagtagaaaaataaataattggctgggtgcgtgcagtggctcacgcctgtaatcccagcactttcagaggctgaggcaggaggattgcttgacctcgggagttcaagaccagcctgggcaacatagtgagaccccatctctaagaaaagatgaaaaaaaaaattagccaggcatggtggcttccacctgtagtcccagctactctggaggctgaggtgggaggatcacttgagcacaggagattgaggctacagtgagccctgatcacactattgcactccaacctgggcagcagagccagaccctatcttagaaaaacaaacaaacaaaaaagattaaagcaataatatgaacaggagcagaaatggaaaggcattccaaggaatcccagagttattccatgagggacaaaaggtagctttccgctgccagagatgtgacttgccctttgcagcaaatataaaagaagtcacttcaggcattctgattgtctgtagctgtagagcaaaccaccccgaaacagtggattacaataacatcttcattaaccttatgaattaaatgtctttaatttttgccagtttgatgagtgaaaatgatattttaccgtttttattttctggtgagactgaacatcttttcatacatttcagactatttgtatttcctcttcagtacattacaggttcatttctctgccaatttttacttgagttgtttgtctttttctttgagacagagtcttgctctgtcaccctggctggagtgtagtggcacgatcttggctcacctcaacctctgcctcctgagctcaagcagtcctcccacctcagcctcccaagtagctgggactacagctgcatgccaccacatttggctaatttttgtatttttttggtagagatgaggtttcgccatgtttcccagactgttctcaaacccctggcctcgagcgatccacttgcctcaacctctcaaagtgctaggattataggcatgagctaccatgtctgtcctctttcttattgattacaggaatatattttgagtattagtcgtttgctatacatatattggttttaattttgtcatatagaaactttctttaagtcagatttcttaatcctttcctttatactttttgcattttgtgccttagatggctttctttccccaggattataagcctattcttctatatttttctttttataatgttataattttggtttttaagcttagccatctggaactcatctctaggaaacaagcgatgcgagactaatccctgggagaagggaaactcctgcagtgatggccagctcaccagctctctgcctgggaacaatatccacttcccagtgcagggagctggcctctgagcagagcacagcagccccactggctgaggaggcggtgatcagagaggggcagccaaagctgcacattttatggaatggggcatcagaaaggaggatgctgtgaagatagggggcccaggagtctatgtgcaggtctccacaagtcatggccaagggttgtgctgtccgtgtgcaggacgaggccactcgaggtttaccagatagtctgagatcagaacagaggtactaaaactggatgtgtgtgtacacttgtcccaggcaaggaccgaacactgaatgcacggcagggaaggagcacaggctgcatttgctgagatttcacatgaaatgttatgtgtgcatttgctttgtatcctctctgaccagaccttcaaagtaagtgtgatcctccctgggcttttattgcacatgctgagctccagtgaggaatgagctgcttttatcctctgtgatctgtaaactgttaaactttccaaaaactaaaaactcaatctgattccacagctgtgataataaagaccaattgggaaaaccccagagagattcagggagtgagactgtttagatcaccatgagcctgagacagctggttcctgcaagaatgaatgtacagcattttctaatcagtctcctgcctttttcccaagaagctttgcttttttctttttgacttttgcagttagtgtacacagagtcagttcattcacagacacctcatggaggcacctggaggtccttggtgaaggtaaagaagtactgggaatgcagccacggaatccagctgtgtcctcgattgaatttagcacagtacacaattcagtgtgtaccctgcagcttgtccccccagtgattgatgttttttaccaaatgttaataaccaaggcaaggcaagtaaccaggcaaccaaggcaagcgaaagcatcttctagaagcaaatgcgcaggctgtgtggttttgctttgccctgtcctgctgcgttattcatgagtgctgtctctacattcccccgtctgcaactttagtacaacctcaacactctgggaagatattcttggatatgcactaaaattagatttttaccttcccatgtgtaattcaatgtcttcatttttctcaaatgacttttgcttcattgaggtggacaaaattctgtatcttactttttttttttcctaaaccctcctagagacctataaccagttttggagatggttggactgttacccttttattaaacatctaagactttcatcaaaaagttccatattccactcagaaatattgctaaagtatttatatcctgggaaaagttaatttgtaattagtaactagcatttccctgggtaaaaataatcagcaagtttctttctgtttttgctccactttttcctccccaaaaatcttgtacataaattccaaatgttagtgttcagagtggacaccacactctagccccttaagacaatcagggtccttccctccttgtttccttcttccctccccctccctgtcctccctccttctctctccccttccctccctccctttctttcttccttccttcctttttttttttttgatagggtctcgctctaccacccaggttggagtgaagtgatttgatcatggctcactgcagccccagtctccccaggctcaagtgattctcctgcctcagccttcccagtagctgggattataggcatgcactatcatgcctggctaatttttacattttttgtagagacagggtcccgccatgttgcccaggctagtcttgagctcttgggcttaagcacctcctgcctcggcctcccaaagtgctgggatttgtgagccatcgcacatgacctcctttttaattgaggtataacatacacatgtgcatgggggatgctcacgaggtgacccaggtctagaaagcacagcattcagccccccagaatcctcttcatgttcccctggttaccagcttccactcaaggataacaatgatcctagtccgttttattcagggatgaatatcaaggaaaataccagaaggtaacagcctacagaatgcctgctgggctgcttttcattttcttctcatggttcttttgatgaacctctgagtctcagatgagtggtccttgggaaaagaccttaccatactaacatccctggggtggtctgtgtttcttcttagttttggctgcttctgtgagcattgaggactgtcgcgcagcagctcagccagatttcacccctctctactttaaggcctgtgccagctctagtcatcccctcgccaaaaatgagacttttcacctccatccaggggtaggtcctggagtgagttctcagcttgctccctggggtgcctaggacttgcccggccacccatgtcccacaaactgctgtttttctgcctggtgcccagtatattggccctgcccacacgagtaccttgctgccatggcttccttgacctctctggtcactgcagtgggactggatcttaacccacctacctgggacccacagaccttgcctagctcctggctgcccagggctggatgcttttccagtccaggaaaccagcccccaagagactggtgaatgatggcatgatcccatcgctgctgcctgcctcttccctccaacccccacgaactggcccccagggcccaggctgcaggagctcctggaaactgtgctagccccaagaaagtcctggctcctggaggactgatccccttgcactccttaggccatcggctgccgtcagcagcctcccctgcctcccctgggctctgctgatgagggtgcaacacactgcatagctcatagcctctgtacgtggtctgcaagggaacagtaatttaaatgacatggctttggccgggcgcgggtgctcacgcctgtaatcccagcactttgggaggccgaggcgggtggatcatgaggtcaggatatcgagaccatcctggctaacaaggtgaaaccccgtctctacgaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaatgacatggctttgaatgaactgagagctctgataaagcataactcaattcatctcttttctgcaagtcatcttccatccatgtggaaagtgtgaatgataccagttgtgccacattgatactgaccccctcgttcctgaaaatacaccttagagctcatgaaagcacaccccagttactggaaaggaagccacttttgttgtaagcacagcagcagagcagcctctgaggtgcacagggctctgcaggttgctgcttggccttatgtctgagtaaggcctaagtacacatagctttttttttttgttttatttctgagaaatttaattattttagttctttttttaaatcaacttttattttaaaatttcagggtacatgtgcaggatgtgcaggtttgttacataggtgtgccatggtggtttgctgcatagatcaacccatcacctaggtattaagctcaacatacattagtgattcttcctgatgctctccctcccccacccccaataggccttagtgtatgttgtttctctccatgtgtccatgtgttctcatttgttcaccttccacttataaatgagaacatactttgtttggttttctgtttctgtactagtttgctgaggaaaggggcttccagctccatccatgtccctgcaaaggacatgatcttgtttttttatggctgcatagtatggtgtatatgtaccacattttctttattcagtctatcactgatgggcatttgggttgattccttgactgtgctattgtgaatggtgctgcagtggacataacgtgtgcatgtatctttataatagaaggatttatattcatttgggtatataaccactaataggattgctgggtcaaatggtttttcttctagatctttgaggactacaaggaacttaaacaaatttagaagaaaaaaaaacaacatccccattaaaaagtgggcaaaggacatgaacagacacttctcaaaagaagacatttatgtagccaacaaatatatgaaaaaaacctcaacatcactgatcattagagaaatgtaaagcaaaatcacagtgagataccatgtcacaccagccagaatggcgattattaaaaagtcaagaaacaacagatgctggcgaggttgcagagaaaaatgaacacttttttttcttttttgagacggtatattagtccattatcatgctgttgataaagacatacctgagactgggaagaaaaagaggattaattggacttacagtttcacattgctggggaggcctcagaatcatggcaggaggtgaagggcacttctttttttttttttttttttttttttgtcccaagacggagtctcactctgttgcccaggctggagtgcagtggtgcgatctcggctaactgcaacctccgcccccccgggttcaagtgattctcctgcctcagcctcctgagtagctgggattacaggcgcctgccaccgtgcccggctaatttttgtatttttagtagagatgggatttcaccatcttggccaggctagtcttgaactcctgacctcgtgatccacccatctcagcctcccaaagtgctgggattataggcatgagccgccgtgcctggctgaaaggcacttcttacatggtggtggtggcaagagaaaaagaggacagaagcaaaagtggaaacccctgataaactcatgagatgttgtgagacttattcactatcacgagaatagcatgggaaagactggcccccatgattcagttacctccccctgggtccctcccacaacacttgagaattctgggaaatacaattcaagttgagatttgggtggggacacagccagaccatatcagatggagtcttgctctgatgtccaggctagagggcaggggcgccatctaggctcagtgcaacctctgcctcctgggttcaagtgattctcctgcctcagcctcccaagtagctggtactataggtgcacaccaccatgcctggctaattttttgtatttttagtagagatggggtttcaccatgttggccaggctggtctcaaactcctggcctcaagtgatccatccgcctaggcctcccaaaaagtgctgggattaacaagcgtgagctactgtgcctggccaaaaagggaacacttttatactgttggtgggaatgtaaattagttcagccgttgtggatgacagtgcacacggctttgaattgtcccccagctgcactggactgggagttgctggtgctcctgatgctcagctagaattagagataattttagatggcaactaggggactcggttggggttgttccactctgagatgaaagggaacgtctttatttaggagtataatgttcttggagcgagtgttatgtcacaaaccatagttgggtggcctctacctctgccaacgtcagcaataaaaagtctgaggcagggaaactttttagagagaagaagagtgtttcctgatcatgggcttgggcttgtctacctgactagatttggacttttataataattcttttttaagatggtacacattctcctttttcctgtgttgtttctctgtggtctcactgctgcagtgccaggatctgcattcaaatacggccgagcccccagagcaccaccagtgcagtctgtcctgaggcactggactctcagagctctcctgcgggtttcagtcattttgtttggtttttcaaccatggctttgatcttgccagactttagtctcaacctgtgacccatttatagttacagatcaagaactagtggtcactttggcaacatacataccaacatggaaatgatacagagaagactggcagggaccctacacaaggaaaacaaaaaaataacttttttttttttttttaaagagagtctcactctgtcacccaggctggtgtgatcatggctcactgccaccttgaatgccagggctccagtgagtctcccacctcagcttcccaagtagctgcaactacagacatgcaccaccacacttgtctgatttttatttttatgtattttatatttatttttttgagacagggtttcactctgttgccctggctggagtgtagtggcatgatctctgctcactgaaacctctgcctcctgagttcaagcaattctccctcttcagcctcctgaatagctgggattacaggcacacaccaccatgcctggctaatttttaaatttttttggtagacgtgaggtttcaccatgttgcccaggctggtctcgaactcctaacctcaagtgatctgcccaccttggcctcccaaagttctgggccaccactctgagcccaaaaactattcttgacagtgttcaatgaactagcatatgggcgccttcttggttgtgggagatggtggcattgttgagcttccggatccatctgacctctcaaatgcttctgaagattttgcagatgaagaaaaatgctgttttgtatcagaaatgatagaagatgtaagtgtgtatataatgttctcatgtttttggaaaagaaggatttagcaagtgttaaagtgaatttgggaagggagcgaggaagggtgagaaggagaacctggcccgtttggatgcacaagttccttggggcggtagcattcaccagtgcagagagcagtgccatccaccccagagtctgttcctggtgggcctggcctggcctcagaaaatggggttctagtttctttaactgacaagaaggaatcaaagtttcaccactcactcctctagaatctgccctctcccaccctcagcctttcctttcactcttgtcgaagacatgaattgagcaagctgcagggcctctttcagcagggtctgctggcagtgtccactgcaaatgggacatgtgcttcagaggcaaatggagctggcgttctggccctgactctggcgctagaaatatttctttttgttctggctttcttatctgtaaaatgggtataacactagtcaccgtgcatggctgtaaatgagaaaatgcacagtgacaggcttatcacaggcactcagcaaatgccactgcccttcccagcccaccattttttttttaaaagacggttttgctctgtcatgcaggcgggagtgcagtggcatgatcttggctcactgcaagctccgcatcctgggctcaaacgatcttcctgcttcagcctcccaagtagctggaactacaggcatgtgccaccacacccagctaatttttgtatttttagtagagatgggatttcaccatgttggcctgtccggtctcaaacccctgagctcaagtgatctgcctgcattggcctcccaaagttctggggttacagcgtgagctaccgcacccagccaagggactcatacttaaaggactttggtcttgctcattgagcatttggttttctatttaaaatgtggtctttctgttggaaacgatctagtatccgtcagcattgctcttgggaaagaacacttccaggcagggcaagcacttgccttgtgtacacagatgccttgagatcagcataatgtaaacgtcaaaacgggtttctggatctaaagcctggcttgctttcttccaggtcagcagtgcaagagatgggtttggagatagggtcgcagccagcctgtgcgtggcagaggaaggaagggggagctgagtactggcaggggccacagtgctctctgcccttcccaagaggaaagcagaaaccagaccctctgttagaggccctccttgttttcaccttcccagggtttgatgtccataacatctggtttgaatgattccagcgaactggatggggcaccccactgccccaccaccgcctgttttttcatctttttttttgggggggggacggagttaatctctgcaccccagctggagtgcagtggcgctatctcagctgactgcaacctccacctcccaggttcaagcaattctcctgcctcagcctcctgagtagcggggattacaggtaccagccaccacgcccagctaattttgtatttttagtagagttgaggtttcactacattggccaggctggtctcgaactcctgacgtcaggtgatccgctcacctcagcctctgtaacctacaaacctcttcagaaagtgtaaaatgaaagcatttccccatttctaaagcagtgtccaggtttcatcaggtagctgtcgaacccaaagagactttgaagccaagagtccacaggatcagcttcccagtggccccagaagttacaagatggggccctcccaacaaaaggcatcctcaggcttttacgtaatgctggtgtgcttagcgactgctgaaagttgactgtgcttgtgtcgtgaaagccaagatgaagagacgttattatggttgtgtgttgctttcagctagatactcctcgctggggaaatgtaactgcaaagcagactccaggacactgtcttcctgaaagccggtgcttttgggggacattctggggcccaccagggtcatcctggatgctgactggaactgagaagaggtttgctgggaagatagggacagattctttgtatctatgtcattcaggtaaaccctacatgtgacatgtgacaccatctcttttgacctcagtttcaaatgagatatttgaccaaccttattgctaagggtcaggctagcttgaaataaccctcaagaaatctagataaaaacctaaatgagattataggctttttttttttgcctaagattatttgcttccagaaccctaaggaaacttcacaggaaacatggtaccatattttagtacacatctccatcctatgcatgttctccagaacctcttcacacacactttgaggagagttccatcaaacctccttctcttattccatcttaatgtcatgcattatttctcttcatcctgcctctccttttcagttacaaattgattctgatagaaacaccctaaatgaccttcccagggcagtcagagagttaacttgttgtagggttgcatttggccatctgggcagagggaggaaacagtggtcagtgtccaccctgtgggagggaggcagcacccaccacagctttccaactttgctggcttcacatttcccaggacagggcaagaagaggaagagctcctcagtggctgtggggagagtgcaggaaggagccctagacttgcccatttcttcttgtcccaaaacccaacacagacctaaaactcagccaagcccaagctatgccccgcttctgcaatctcttgcaaggcccctgcttaaacaacctgagctcccagctttagtaggcttgggaacttgatgcttcatttgggacaaactttgtggatccagggaagaaaaccttgttggggtgagcaggtggccgacaggactgaggatctaagaggtggggatgcactggagtccccagctggcctaggggaccggtacaggagtcttcagaagccaccatctcgatgggcagggacttagaattgaattttttttgtttttgttttttttgagacagaatgtcacctaggctggagtgcagtggtgcaatctcagctcactgcaacctctgccttccaggttcaaggcatttgcctgcctcagcctcccaagtagctgggattacaggtgcccaccaccacacctggctcatttttgtatttttagtagagacggggtttaaccatgttggctaagctggtctcaaactcttgacctcaggtgatccacttgcctcggccttccaaagtgttgggaatagaggcgtgagccaccatgcccagctagagttggattttagtttccttatcactgtgtaccaagcagctgctgggggctgcacccatcccgatggaggagcttctttctccccatgcagcctcatgctccctgcttgtttggtgtgctgacggggctgctgaacaggacgggttttcttttccccctgagaagcctcctacattgtggggagaagagtgtggtaggaagagcaatccagagacagtcttgtaggtctttaagaccttctcatcttggtctgcttgttgcgaattggggttatacagagatggtgatggtggtagtgatgacggtggtggggatgatggtcatggttatgaaggtaatgacgacggtggtggggatgatggtcatggttatgaaggtactgatgatggtggtggggatgatggtcatggttatgaaggtactgatgatggtggtggtggtagtgattcctccttgaccaaataagtctgggaaatgctggcatgtacaaaactaatcaggtgggttaatttgagaataagatatctttgagcctttaatgactctcctgagggatggacagaaatcctctactgttttgagcactgaaggcttttcctcaatactattctgtgaatggatttgggcaacaccaggccattcctggtaccaaaacaaaatgtactctgagcaaatttgggaagtttattcttatgttgccttactgaaaaatccaaaggtagattcccatctattattattattattattattatactttaagttctggggtacatgtgcacaatgtgcaggtttgttacataagtatacatgtgccatgttggtgtcctgcacccattaactcatcatttacattaggtatatctcctaatgctatccctcccccctccccccaccccatgacaggccccggtgtgtgttgttccctaccctgtggccaagtgttctcattgtttagttcccacctatgagtgagaacatgcagtgtttggttttctgtccttgtgatagtttactcagtatgatggtttccagcttcatccatgtccctacaaaggacatgaactcatcctttttatggctgtatagtattcgatggtgtacatgtgccacattttcttaatccagtctatcattgatggacatttgggttggttccaggtctttgctatagtgattagtgccgcaataaacatatgtgtgcatgtgtctttatagcagcgtgatttataatcttttggatatatgcccagtaatgggatggctgggtcaaatggtatttctagttctagatccttgaggaatcaccacactgtcttccacaatggttgaactagtttacagtcccaccaacagtgtaaaagtgttcctatttctcaacatcttctccagcacctgttatttcctgactttttaatgatcaccattctaactggtgtgagatggtatctcattgaggttttgatttgcatttctctgatggccagtgatgatgagcattgtttcatgtgtctgttggcagcataaatgtcttcttttgagcagtttctgttcatatcctttgcccactttttgatggggttgtttgattttttcttgtaaatttgtttaagttctttgtaggttctggatattagccctttgccagatgggtagattataaaaattttctcccattctgtaggttgcctgttcactctgatggcagtttcttttgctgtgcagaaactctttagtttaattagatctcatttgtctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtctaaggtgtaaggaagggatccagtttcagctttctacatatggctagccagttttcccagcaccatttattaaatagggaatcctttccccgttgcttgtttttgtcaggtttgtcaaagatcagatggttgtagatgtgtggtattatttccgagggctctatgctgttccattggtctacatctctgttttggtaccagtaccatgctgttttggttgctgtagccttggagtatagtttgaagtcaggtagcgtgatgcctccagctttgtgctttttgcttaggattgtcttggcaatgcaggctcatttttggttccatatgaactttaaagtagttttttccaattctgtgaagaaagtcattggtagcttgatggggatggcattgaatctataaattaccttgggtagtatggccattttcatgatattgattcttcctatccatgagcatggaatgttcttccatttgtttgtgtcctcttttatttcgttgagcagttgtttgtagttctccttgaagaggtccttcacatcccttgtaagttggattcctaggtattttactctctttgtagcatttgtgaatgagagttcactcgtgaattcggctctctgtctgttattggtgtataggaatgcttgtgatttttgcacattgattttgtgtagattcccatcttatcacaatcttcctcatctgtgatactgcacagtttgcaatagttcttgtttattactacttttctctcctgcagaacattgacatcaccaatttcagcagcagctggagcgatggcctggccttctgtgctctgctccacacctacctgcctgcccacatcccctaccaggagctgaatagtcaggagaaagtaagtcatggccctgtcaccttggttatcctctaagaaatgcaggagtcctaattgataaaccccactgtgggagggggcttacaggcctgaagtagaagttgggatattgataccaggtacagataactcctgaatgtttgactgcaccgtggaatcccatcctcagcaaatcttcctcagtttcccttctcaggaatctcagcttcatggtttcaagaccttggccagcatttttcaaagcctattccaaagaaccagcaagcaccaacaaaaagaattccctgttcaaataagtcttggacactgtatattgcatcacattttcagagagcatggtgcctgttaacacattaaagacttcaagaagtcctacattaagaaatctatgtgactgtttaacacagcatagatcagatccacttaacctctttacttatatttgtttgttttactacaatcacacaacaagggttggcaaattttccctgttaagggccacgtaatagactcagtgggtcaggtggtccagtcacaactgttcaactctaccatcgggctaaagaggccattgatcactttgtaaatgaatgtgcatggctgtgtcccaacaaacctttatttacaaaaacaggctatgagccagatttgggacagcagtttgccaacccctgacctagaacctcctacaaaatgtcccacagagcatactttggaaaatactgtgctgggtcccgctgttggtcactcaagaatttcttgtcaagcatcgggcactatcataagaaaacaggcaacaatagagacgttctatgccctcatgagctagacagataataagcaagcgagtagacttataacaagtaaaattataaattagcaaggataagtggtctaagagcccagagagaaactcagtgctgtgagacagagtgacggggatcacatttagaccagggagactgcagcggtgatgtcagaactggtgttggggctgggcatagtggctcccgcctgtaatcccagtactttgggaggccgaagcgggtggatcacttgagttcaggagttcaagaccagcctgcccaacatggtgaaactccatctctactaaaaatacaaaaattagctgggcatggtggtgcacacctgtaatcccagctacttgggaggctgaggcaggagaattgcttgaacctgggaggcagatcgcaccactgcacttcagcctgggcaacagagcaagactcctcaaaaaaaaaaagaaaaacaaactggcattggaaggtagaggaggcagcagtgcagagccagggctatggagcagcagcagctggggaacaccttggtgttgtccaggccgtggaagaaggctggttggctggatgcagttagtggggccagagaggctgtgctgatccagggaagtggagggggcagacccccatagctgggctgatctggggagtctggggcgggagaggcgacagagcttccccacagctctggtttggcctcacccactaaccatgagggtggtagcaacgcagacggaaagacatagaaggatttgaaatatgtctcagacagaatcaactggatttagtgacagattggttgtaggggaggaggagaggaaggagtcaaagatgacgccctggtgtctagtttgaaagggccattttctgagatggggagggcatagatatgtttaaaagctctgtttcgattatcccacatcaggatttaaataaagtacaaagaaggatcatagcaatgacaaaaactgagcaaagtaatttaatttttaaggtgttagaattctccaaaaaagcagaaccaaaagagagagagagagagagagagagagagtgtgtgtgtgtgtgtgtgtgtgtatgtagagagagagagagagagaggtgggggctggggagagagatttattctaaggaactagctcgagattatagaagctagcaagtccagcatctgcagggtaagccagcaggctggagactcagggaagagctgatactacagtcccaatgtgaaggccatttgctggtggaattccctcttcttcagtgaggttagccttttcttttaaggccttcacctgattagatgaggcccacccacactaactggggtcatttgctttgccgaaagtctcctgctttaaatgttaaacttgggccatgtgtgggggctcatacttgtaatcccagcactttgggcggctgagacaggaggatcacttgagcccaggagtttaagaccagcctaggcaacataggcagacctccatttctacaaaaaaaattttttttcaattagctgagcttggtggcgcacatctgagatcccagctactcaggaggctgaggtgggagaatcacttgactctgggagtttgaggctgtagcaagccatgattgtaccactgctctccagcctgggtgacagagaccctgtctcaaaaaaaaaaaaaaaaaaaaaaaagaaaagaaaaaaaaccttcacagaaacatctagaataatatttggccaagtatctgggtgccatgcctatccaagttaacacatgcaattaaccatcacagaatgtattaaaatatttaaattacttttctgtggggtgctttgtttgtgaagcaggctgtacaggattattaaacattctgggggaaagattgtatttaaatcatgtgaagtctgaggggctgtgaaatatgcaggtggtgatggcaggcaggcgattgcacagcaaatccggagctggatgggagagcagagcttgaaacacagatctgggggtcgtccatgaagagatccatgctgtctaatgcaggttcctgggatgatgggaatgttgtgtatctgcactgcccacagggcaaccaccaaccacacctgcttttgagcacttgaaatgtggcagatgtgactgaagactgaatttttaatttcaattttcatgttaaataaccacatcatgtgtggctgccatgttggacagcatgggcacaaatggaatttaaagccattaagagtggaggagagcacccagtcccttggtcttagggaagcatacagagggaggaccgaggaacacacctgggaaccccagtgtttgttgtggaggtagaggaggaggacacagcaaaggggaccaggaaggagcagccagagaggtggcctgagctggggccacaggcttcagcggcctcacgggtcacaggtgtcatctatgcatttattccctccctgccctcttgatgtcttagtgtctgcttttctgatacgatgttggagagataactgaggaaatagtgggcataaaagcactgaaaatagtcagaaggcctttctaacactgtgctgggtgaagcccacacatgcacacacctacgtcctcctgacagtgtgtgtgcgtcactccctgcagtcatccagacagactggctgctttgtccttgaatcagcatggctgtattggaaaattatggacctaaaagtgtttgttctcaggctccaaattgtgagccttgcctcctgggccagagcccctgtgtctggccctagtctctgcgattctgagcgcagaggctccgccagctgcccaggcctcccgcagccgtggcagcatgcagtgggggcaggctgaggccatggtataggcccctgctccctacatgcagggttgaatttcttccccagaccaatcacccgaccaccagggagtgtgtaaggcagcgtgtggaagactgtgggtctgtgatgagagtctgagtcagccctggatgtctggaatttttcattttaggatctgtttggcctcacagtaatcttgaattgggttgtgtcccagagcctaggattttatttgctaattacagcccgtttgccactctctgaaggaacaaccagcctcctgtttcctaaatgccccatcctggccacactctggaggagccacagtggctgcagtgacatttcgccacttcttggtgtgtggcttgccctgggggatgctggcgttctttttggtgagagaggccatatctatcacagttacgggtgtgggttttcaaagtaacgtatcccaacaggcagactcgtaccatataaaactgagcacacggggggaatcttactagagcagagaggggaaagagcaggaaagatttcctaaaagtgtgttagaagctgggattcacagggagcaagtggatgtgaatacagcacataccttgggtcatcaggatgagaggcacatgtgtccagccccagcctggagccgtgttcccctatgtgctcagtgccagggcatttttttttttttttaatttacacttacatcagaaagggcaccaagagaagcctttaatgtttgtaaaactattaaaatcaaaatctaaaaagtatgtgatagagttgttgatagcccagaatgtatagaaattatgaggtgtccccacctggatggaagcaattaaactatgtctgacattggtattaagtagagaatttctgataaaaactaacaagcatgtcttctatgatagtaaagagatatatgatcacagggtgcgatttacagtccatgaaagattttgtcattttgttgttgttgttgctgttttgagacagagtctcactctgtcacccaggctggagcgcagtggtaccatctcagctcactgcaacctccgcctcccaagtccaagcgattctcctgcctcaacctctcgagtagctgtgactacaggcacacggcactacacctggctagtttttatatttttagtagagatggggtttcatcatgttggtcaggctggtctcaaactcctgactttaggtgatccacccgcttgggcctcccaatagttctgggattacagtggtgaatcactgtgcccagccatttttgtttttattgttttcagtaaaaagatagggcattcacttgtccgcctttgcaactctctgcttagtccagacggactcaggtagtggactggaccttgcttatgtcagtatctgaaatgaatgaagtgtgaccctgagagggggaactctaggattggcatctttctcccgtcggttttgagtgtgaggcccaacgggcccaacccctcaatccctgctggtgactaagagttttgccacaggttgggcacttaggctgtcctggaactggaaggtcccaggcctgcaccatcatcccccgaccagggcagactgaagcagtgatggcgtcaccctgcccggctcctgtgggctgagctgcatctgaagcttacagcccgtgggggaagtgaggcccttcggagctgctgcttgtctgtggcttctgcctcccaggtggcctctgcacagtggtggtgacagtgatcaaatgaaagagcattgggataataacacttggtcacagatgttctgctgctgcaaaaatgaataaaagttactgttgtgaataaaaaaccaccccctctctgtattctatgtcaccctgtatactatttcagggtattttgagacagtttttcatcaagggatcctcccacctcaggcttcagagtagctgggattacaggcatgttgccaccacgtcttgctccgcttgtgttttcacaacagatactgaacatagaagaaacagcatgcagcacactgtgaaaacacagcggtgccaggcgttgtggcaacatgcctgtaatcccagctactccagagcctgaggctgggggatcccttgagcccaggattttgaggctgcagtagtgagcccatctaaaaaaaaaaaaaaaaaaaaaaaaagaggaaagaaaacaagtggtttcattagaatcaaactagaaggtttttgcataaaacgttgagtttaaaaatgctttctcgttagaccttactagtaatcaatacaaattaaaacaataaaatatttttagcctgatacatttggcagagacagtacaggaaaatagccacttatacactattgctggagccaaaaattggggtaacgctctagaaagcaatgtttggcattacatattaaaagccataaaatatttgacttctggaataatggtggcctaaaaactggctaaaaaccaaaaggactgaagtaaacacaaagacctcaatagcaccaaaataggagattgctgccattaatttgggctaaatggaaggaagccaggagttcacagctcccctctcagcagaacagagtagtgttagggtaacaagtgtgcagtttccagcccatgcccgctcctttcctttaatttcaaggaaggggcatggcagcttgggcaggatcaccacagatcaacagctttccaaggcatgggccacagactggaagaaaatgtggtggctacatctttctgtttttttggtgacctggtgcctagagtttgcttcagtgtcagggaaaacccgtcgcttcaggctctagatgttcaagcaagggtagagagtgagagccgtgggggaaatggaaaagggtataaaatgatgtatgaaatctaaaatacataattatgtataaaatctaaacatacaaaattaagaaatttggacaggtgctgtggctcacgtctgtaatcccagcagttcggaagactttgacaggcggatcacctgaggtcaggagttcaagaccagcctggccaatgtggtgaaaacctgtctctactaaaaatacaaaaattagccaggcgtggtagtgggcgcgtgtagtcccagctactagggaggctgaggcaagggaactggttgaacccaagaggcagaggtggcagtgagccgagatcgtgccactgcactccagcctgggtgacacagcgagactccatctcaaaaaaaaaattaagaaattctactgaggaacataatggccaggtgccatagctcacacctgtaatcccagcactttgggaggctgaggtaggcagatcgcttgagcccaggagttcgaaactagcctggtcaacatgacgaaaccccttctctactaaaaatacaaaaaaaaaaaaaaaaaaaaaaaaaagccaggtgtggtggtgcatgtctataatctcagctactgaggtaactgagaaacgagaatcacttggacctgggaggcagaggttgcagtgagctgagctcaagccactacactccagcctgggtgacagggcgagattccatctcaaaaaaaggaaatttcactgaggaacttaaaactgaatatgtagagaaacatttatatctcaattatacttaatataacaatttaattttaatataatcctaataattttgaaatgaattttggaatgggagaagcatgaacaaatgattcttaggttcatctagatgaacaaacatcagagaatagccaggaagagtccccaaaagaagccacacactagggctgaatgattgtggagcactaccattaacattctaaggggaaattattttcagcctcagattccctgtccagccagcctgttaactgaacgtgatggtagaaaggagaaattttcatacatccagaaaatgtgtctccccatattctttcttaagaaggaacctaggcaatagaatgggggtaaaatccaaaaatcagtgaggttctggagggcttggggctgtagggtttcatagaatgatgagatgattaagagctcgaggctgtgataaaggagaagatgagaaactgtgcgaggaagccagggtccaactatgaggcaggccctctgtgtcagaatagaatggcggcagccacaaggagaatgttaggacttaaaagcaacagtcagaatgggcaagaggccagatgagaaggaggcacaaagcccccctcccagtaaggaaaaccccaaacaagcagaaactgtaggaaaaaaacaaacttttgaagaaaggcagggtccaaatctggggcacactaaaatgtggggtgattttgggcgactggtagagtaacagaggaactcctttaaatgatgctttgagtggctcaggtcatgatggtggagctgtagaggacacgtgcccacagctggcttctgtgatgccgcttgtggttttcagcttccagaatcattctagtcagagagcgccgaggacttaaatgtgcttccagggaaggaagcaaaggttctcagctgtgacaatgtacaacttgaccaggtggagggaagaaagggtaatttactcctgacatacaaagtagagtcaggaagtgttgtccatacccagtgggacaaaaaatagaagttcaaggatattatttaaggtcacaaacatagctaatattaatacgggcactaaaattagctatgtgtctatagtgtaaggaggaggcagatgcatggtgcctgagtcctcatatgtcctggaggaagtcagtagaaaatgccttcattttagaaatcaagtagtagtcgtattagcatattacagagatacggaaataatccataactaaacagaaattgaaaggtagttctctgaaggaccaggattgaaggaaggaacaggttttcatttgatttaaatacaatctatatatactataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattgacatctgtttgccgaaagtctgttgctctcaatacctaatatagagttatccagttgatataatcacatatcaacatatgatttagagattttcaatcgcataagatttcatatggacaaatttcagttctggaaacacagtggactgaattattattagagccctcttgttcagaacacctagaaatctgaataaaatgctatgttaaaaaatatcaacacatagctaagctcttaataaagaatgggaaatacccagatgccagaaatgtaaaacaaagcagaaaccaggcacaactgagcctgcaaaactcggcaggggtgggtgggggatggtgggccaagcaagcagcaagcctgcataaagccaaggctcacaacatgctgatcttcttagtgaaagcagaaatctctaaaactccaccagccagcccagggaggtgataaggaagctggtttccacctgggattgtgtgcgcacgtgcgcgcagagagaggaaaaggagagagagaaaagagagagagtctcttgcaaggaaaggaaacagggccagatgaggtttagagtccaaatttataatatctgtgctgcatgaagcccttagtatactcttagatgcaggaagcccctgggctgatactacaatggctgctaaaaagtaacagaacacttgagaaaatgatctacttgagctagtcagcagatatagcaaacaaaaggattatctaccagaacttgagatgataaataagagactaccaaaagactatttaaacatgaaagagataaaaggaggaatagaaaccacaaggaaagaatgattctatttaaaaaagagatttgtaaaaagaatctaacacttctagaaatgaaaaattggaattaagaccacaatatgtgttgccaaactcattagatacagcagaagagagaaatactaaattggaaaataaatacagggagatcacccaaaatataaaagagacattaaaaaatataaaatataatggtaaggttgaattagtatgtgttcagcttcaagaaatggaaaacccaaccagcagttgcttaaaccataaaaatgttaattttcttaacaatagtagttttagaactggttcaccactcagtattgtaatcaaagccccagagtgtctcctctccattctcaccatctttaatctgttccttttgtccccatgcttgttctttgtggttgaaggtggctgccaaacttcagacatcacttccacctacagggcaggaagaaggggaagagagagagcaagtgcctcctatctttccctttaaagaatgaaagtgaaaggctccctgggtttctccagctcattggcagtactctgttacatggtccccagctgcaagggcatttgaggaagtgagcatatgaacagttttcagtttctttagtgggaagcctgcgagggagagagcttgggaatgactgttgggctatctaaataatagtgtctgtctcagagtttaagagacagggacaaaaaaaatcagacaatggccatgtcccatgcccagagggaattccagatgaaaaggatagaaagaatggaatggagacagtatttgaagatatgatgcctgaaaattttccagaatgatgaaaggataatgaaagagtccacagattctttatttatctcaagcaggatgaataaaacaaaatatccatctagacatattgtaatgaaactacagaaaaagcaaagacagataatctattaaaaatttctgctcaccagtaataaaaatacaacctagtaggaaattatcaaagactagaagagaaaattcacagatgatgatgatgaatggtcaatgaggatttttaaagatgttcaatctcattagggattgggaaaatctaagttgaaataaaaatgagataacaattccagctgggtgcagtggcccacacctgtaatcccagcactttgggaggctgaggtgggtggatcacctgaggtcaggagtttgagaccagcctggccaacattgtgaaagcccgtacctactaaagatacacaaaattggccaggtgtggtggcgggcacctgtaatcccagctactcgggaggctgaggcaggagaattgcttgaacccaggaggcagaggttgcagtgagccaagattgcaccattgcactccagcctgggtgacaagagcgaaactccatctcaaaaaaaaaaaaaaaaaaaaaattccataaccctcaaagcatgtggggaatctgagaaatgaaaaagtgaatgtacatctattgtgaaatcttaccaccatgaacagtgctatgccagtgtaattttgaaacagaatggacagttttctagaaaaatacaagtatgtttcttcaaatattaaatgtaaatattcctatgaaacttaagaagacataaaactttaaccattgaagaggttgaatttatgctttaaaatgtagtcacacacacaaagaaaaaatatccccatcagcccagattttgctaaatctttaagacgcagatatccctattgtgtatttacaagtctgggaaatttaaaaaggtgtgaggaaacttacacatctgaccagggtggagtagcagggatctcccttcagaaacaacaaaactaaggagtaccaacagagagatcaggtaaggataaagatacaatgagaccttgttggaagattatattttacacagaatacatttttctttgtagtgttgtaattaatatttacttctgtttaaatataatatctttttcttaattttcatctaatgtgctatagaagttagtgagctgggaagtgaatgaggtcattttgttgtcctaattgtcagagccaggggtttcattggtgtggatggtctgtgaggagctgctgacacacatgataattaatctcaaaggcacttaggagtgtttgtgagcactttcccggctttttccaccaacaaaatagaaatttcctacattcttaaatttgcttttcagtaccttgatgtggattggaaaatccagtatgttgaattacacatgacactttaaaactacacccagtcagaagtgacagcagtaatccccaaatcttcagtcaagttctgttgttagattatgccaggaaaattgtcttatatgtttatattcaagtaaatataagtttctggggtataacatattaggatgagatctttatttttataatttcaacttttattttagattcaaggagtacatgtacaggtttgttacatgggtacactggatgatgctgaggtttgggatatgagtgatcctgtcacccagataggcacatagtagccgatagtttttcagcccttgcctccctccctcctttctccctcttgtagtccccagtgtctactgtccccatctttatgtccatgactacccaatgttgagctccatttataagtgagaacatgtcttatttggttttctgtttgtgcattagtttgctgaggataatggcccctagctgaatccacgctgctgcaaaggacatgattttgttctttttatggctgcatagtattccatggtatatatgtaccacattttctttatccagtctactggttttctttctccttttcttttttttttttttttttttgagatggaatttcgccttgttgcccaagatagagtgcaatggtgcaatcttggctcactgcaacctccgacttccgggttcaagcaattcttctgcctcagcctcctgagtagctgggattataggcacgcaccaccatgcccagctaattttttgtattttttttagtagaaatggggtttcatcatgttagccaggctggtctcaaactcctgacctcaggtgatccacccacctcagcctcccaaagggctgggattacaggcatgagccactgtgcccggccctttatccagtctactgttgatggacacctaggttgatttcatgtctttgctattgtgactagcactgtgatgaacataagtgtgcatgtgtttttgatagaacgatttcttttcttctggatatatacccagtaatgatattgctgagtcaaatggtagttctgttttaagttctttgagaaatctccaaagtgccttccacagtaactgaactaatttacatttccaccaagagtgtattcccttttctccacagccttgtcagcatctgttactttttgacgttctatcaatagccattctgactggtgtgagatgatgagatctttaaaaatgaagctctatagtgttccccagatattagaaagtgttctttctcagccaccgtgtaaggagagcatcttagccagcccaattacagatgcaagcaactccccagaaaaggaattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgcaaggtggatgcactctataagaggaaactgaggcacatggcttatgagcgggaaaggcaagaggcaaggccaggcaggcagctccagagcgcatgccgtcaaccaccctgacagctgtgtctgccttctgcacataccttgttagatttagaccttagtggggtttttttttttttttttttggtgctattgtaaatgttattgtttttcttattacaaaatccagttgttcaattggtacataggacagcaatggacttttgtatactgaccttgtatcctgagacttagctaaacctgcatgtaaatgctttgggatttttctaaacaatcatatcatctgcaaataaaggcagttttatgtctccctttccaatctgcgtgccatttgtttctttttcatgccgtttagcactagctagaacttccagtacattttttttttgtttttgtttttgtttttgtttttgagatggagtcttgctctgtcacccaggcctggggtgcaatggcatgatctcggctcactgcaacctctgcctcctgggttcaagtgattctcctgtctcagcctcctgagtaactgggattatagacacctgtcaccatgcctggctaatttttttgtatttttagtagagacggagtttcaacatgtttgccaggcctgccttgaactcctgacctcaggtgatccacccgcctcggcctcccaaagtgctgggattacagtccagtacagttttaaataggacagatgagaaaggacatccttgccttgttcatgattttacggggggaatgttcaggtctttcaccattaagtatgatgtcagctgttggttttttatacatatcctttgctaggtaaaagaggttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaatagattgtgtattcatgagaaattggcatgtagatttcctgtaatgtttatgtctagttttggtatcaggataatgttgggatcctggaatgagttgggaattattctctcctcttccattttttgaagagattgtgtagaattggtattatttcttccttaagtatttgatagaattcacaagtgaaatcatctgggtctggtatcttttggagggtcttaactactaattcaaacaaatgtcatgcactataagattgttactaatgcagcatactctgtcttctgaaatgtataacatcttttcacaaattctcaaatatgttaacaatgtactaaatatttttagttcagttatgaagttcaagcatgtaagattgtctgctcaaaactgaatattgattggacttcggagtcctctctgagattaaagacacaccctttccataatacagaggaaagtgtgcagtgtgccatctctcttgtgtttgtaggtatcccttcttttcccagagctcatctatgtccaaattgcatgcccaattcttcatcagttcctttctgtaagtcatgttagcaacactccttggtacggattttaggttgccaggcctcagtctgtgtgcagtcatgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgcatgctcattacaagcttacttgcaaaatgaacaaaaataaatcagtcagtaaaaaccagcaaattagcaaaagtaaaataaaaataagccaaaaaatcaccaaactgtattaaataacaaacaaacaaaaaaacacattaagtagtaacaatgctggtaaaataaatggttgcatttgaaattggttcaaggcttttgtgataatcccactcagtaatttatcttgagggactagttcgacagaaggaaacaatactgcacaaagatgctgattgcagagtctgtggtggtcacgaggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaa

SEQ ID NO: 493 - DNA, 150149 bp, Homo sapiens
agaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtgacttctgctgatgggatcaatgaattttactttggaatttttcttctgatgctgtatggaaatctgttcttttccttatttactgggaaagaatctgaggctattgggatgatttttcatctcaagactgtgggaaataatcagctttgaagcatttcctgtggccatttgctgaagtctgggattccgtcagctgcgccccaaccagattttcagtgttaatgtttccatgttaggtggtgaggctaagcagatatgtcatgtgccggctggtctaggagccagtgtcccagggctctcattcttcctctggaagtctctccaccgtggcactgctgacattgtaggccagatgcttccttgttgtagggctcccctttgggttaccgatgtctagcagcatctctgggctctgtccagtagcaccccaagttgtgacaccgtaaatgcctctgcacattgccacgtgcccattgggcttagaactactactgtagaagaggtcaggagcaaattcgacccatgttccaaaaagctccagctcagtattttcaacatgtggttcacttacgttctatttcctgctgagtcccctggcaattgagctatgtgcacattcttattttgttggttctcagacttgaatggtttggcctcttccgcttcccagtgcttattgtgcttgtagccgagccctgagtgccctctcccactcctggagactcgtcattattttctgattgtccagaatggtttcccagttgcctttctatttcttgccttaaaaggataatgaagctgaggcccgagataacctctccaacgcaggctccgaaggcagcaatttagtggcggaacagcgtgttttcagggagcaggagacgtgtggactctgactttaactgttgcccagcgcctaattgtattccttaaataggggttccctctctcctccttttctccctccctcctttctcttctactttacactgtgaaatttaagagttgcagtttaagtcctacactattctggagaggagagaaacttggtaagaaaataaaatgtttgacaaatttaaagaaaacacccctggaacgacatcccccaccccaccatgggtgtggggtcctagatttaactgtaattccttgatcgatgtgatcctttgtggtgttcatgaggattttaggaaatcatgagattaataatagaaaccttcttttcactgtcttgtacttggctggagcctgtttattttgtatggctaattcatatccataagaaaacgattactcagctagcattcccacctgtgtttatctttcagcagccaggatttgttaagccctgggcaattttaattgctgtgaagtgtcttccctgcaggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatcaacagtttttgtcgagagggcggctcatagttgtcaacagccttctgtgtgcctggcacctgatggacttgttctcctttcatctttacagttttatgaagttggcactgataactccatcttattgggtgaagatgtagagaatcatgttcagaaagcatggctgagttcacaatgtcaacagtggagctgaatttggaccaggtgcatttgatctatagccttggtgctctccagggagcaaagattattcagagaggccatccgtccctggtgtttaggtgtgtaggttttggaaccaatttaaactggatctgaatcttggctccaagataaactctgagatttgggcaagttgcttaacctcccttggggaaatgaagtttccccacctgtgaaatggatatgtcttagtctgttcaggctgctgtaagagaaataccataaactgggtgacttataagcaacagaaatttattgctcacagttctggaggctgcatagtctaagatcaaggtgccactagatttggtatctggcaagggcctgctgtctggttcatagatggagtcctcttgcagtgccctcacttggtggaaggggcaaacaagctccctcaggcactaattacattgatgagggctctgcctcccagatgccctacctcctaataccacaatgggggttaggttccaacatgtacattctgggagaacattcagatcatagcaggaggtgacccttacctcgtagggttactgagctatttacatagagcatttagcagtgctttgccaggctcagaatgaaataggatagctgctctcagctcatgacagcatttatgtaaatgaactggcttcagagagccaggctgaggggctgagatgacgggagggatgtagaagtggtgggaagtggattgggaggaaacctgaagaaacttggagtgggcctaggggtgcacctgctccccttctagtaggagtccttcctgcaagtggacggagggcaccatattgtgggttttttgtttttgtttttgtttttgttttttgttttttttttttttggagatggagtctccctctgtcacccaggctggagtgcagtagctcaatcttggttcactacaacctctgcctcccgggttcaagtgattttcatgcctcatctccccaagtagctggggctacaggtgtgtgtcaccacgtccccctaattttttgtatttttagtgagacagggtctcaccatgttgcccaggctggtctcgaactcctgagcacaggcagtccatccaccttggcctcctaaagtgctgggattacaggtgtgagccactcccagcctatattgtatattttaaatttgagaagaagatgggatttgaggagcagtgtatggctgatgggtgggtacaaaatggaaggccttgcccaggaaaacaatgatgggaatgaagccgaagatgctcaggaaagggagtgtgggcagcaggagggggatggatgaggagcattttctgggtgcagtcatgtgggagtagttgggttgaattcagagggtccaagagaaagggaccctgatgcaacaaacatgggcctggacagtgctgcctcagagcgggccacctgccaaccctggaaaggaggctgcgtgttcgtcaggggcaccatccacaggatcgacgcatttgttgccagagattaagagagaagtttagatcttttaattttgactgaggtggcttttccttcttttctttaaccaaggacttagactcctgaaatgttggggaaaaggttgacagggaaaacatccaccctcttcctgctgtttttcatctctatatttttctcttttgtggtggtgtggtggtgggcaataaataaaaggcatttcatttcaggggtaacctgggcagattttggaaaatgtagacagattgcaaaatcatcctatgttttcataaagtaagccctgtaatatccagtcctttattttttttttttatttagagagaggttttcactctgtcactgtcccaagtagctgggactacaggtgtgcaccaccatgcctggctaatttttgtattttttgtagagacagagtcttgctatgttgcccaggctggtctcaaactcctagactcaagtgatcctcccactttggcctcccaaaatattggaattacaggcatgagccactgtgcctggactgtaatagtcatttctaagtaattctaatcataacataaaagggtgtcttgattaaacagatactttattaagtcatctccatgagtcagtcagactgacaggttgctggttgattctgcagtaattggtgaaattcatcagtaattctcttcaagagtcactccggctctgttcattcattttatattgggaggaggtcctcatgaaattagttactgtataggtctcaacctatgcattctttcattgttgctgtggaaacaagcaataaaaatcgtgggttgaagaagaaaaataatcggtgctgaacatctgtaaaatacatgataattaacttgctttctgtaatccagaattttaaaaaaatcatcatacttggaacaaagctgagactcataaggttctgaactaattatgtaactgaatcattaatagttttccttggaaacactgtggaaaacaaattacgccgcctttaaaggagtgtttccactggtagcagcattcacagagccgctgccatcagctctgcagcgtgagctcagtcagatgcatgcctggacacacgccaccagctggtcactgtttcaatagggtcgggaactagatggtcgggaactagagagacattgtcaggagaaacaaggtcgcagactgagcaggatgctgcctgtggttcttctcgtggctggctaacgggctgtgaggggagaggcagccagggacgctagcactggccgccatcccccgggggcagttagtgagacccaccctgcccccaccctgtgcactgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggtttgaacaattttcctttcataaaatattgtagttagggcagtcactctgcccaacagtgttgggtctgaccaattaaaatatgcttcattaattttttatgatacccatttttatccaaaagaagaaaaaagtcattttgtgcttctgtgaattctttcaagtaattcatttatgtttattttaaaaataagtatattgttcctttgtcaaccctaaagccacaaagcttatgggcattttattggttgactctggctgacctgttttatctgggtgtgagatacagatacatagtgtatgggtatttggtggaatgctgtctcaggtcattctgctgaaaagtgatgtcaggacatcagtaatgtggatatgtttcagtagtttggtaaaagctgttatggagttgtaaaaattagcctagtataaagcctataaacccatcttaggaatattctatttccagccaaatcataggtgctcctactctgtgatagttcatggtgacgtggtatgtggggtgtaaagtgtgatgatgtcatgcagcaggttcaagtgatggagacatgtttttcttttctgctcttttgcaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcagggtatggatcaaaatgcacagggccaggcagagcgcctggataccctgggttgggaggattgaagagggcagtaagcaaaccagtggcctctcggggcagggaaggaggctcccaaggaggggtcgcaggaggaccagcatgcctggacatgaaggaatagagctagcgggtgggagtgggggccctctggggtccagaaaggaggtctgcaaagtgtttaacacagtaattaaggtcctctgccctgggttgcatggacatcccggcagttttgccccaagcacggccctggataggggtcgaggtcatgcacgatctttgcagccccccacaatccagttgtagttcttcaagcccctcttactggaccccgcagcagcatggacgctgttgattacgcccttcatgagggagtgcgttctcctctggttttctcctccccccatccctttggtctctaaggttgggtgggcccatgccacattcctagactcatctcttttctagctgcattcatttctttacatgagaggctctcaccgtgcaaagcctagtgcctccttagctgccctgagatgaattcatagacagtagcacctacctcatgcaatactttagaaaagtcaatatgatcttctatattagcatggatttccatctgcacagctgtgctaaaggccttgagatgctccttaaagcaccacgggcgtgacagctacaatgcagatggatttgagatgcagactgatttgaattgtgttgatgactcaactacggtgaaggctgctgcagaaggagtgacgggattgttttgaaatagcagacactcttggtgaagttctgaaccaagcatggtgccggctccctttgttttagtatttttggacttagagcagacactcttggtgaagacactcttagagctaggcaaggggcacattgtttttatgagtcaaatggagggaggctctaggctcagataataataaaaggtgttccacctgtgtcagtgcctgcggaatatgtggaaagtgtgtgggtcgtggagcagttctttgtgtaagattgtcatgagcattttaggacatctgaatttcctgtcctcctacccgttaaatattagtaacacatccagtcatggtgacaaccaaaaatgtgccctcagattttcaacacatcccctgagggacagccctgtccccattgagaaccattgttctaggtgacgggtccattctcatggcttttaacactctaagtggataacgtccaaatttgcatctccagctgggacccctctaactgcctttgtgacatcacccttggatgtccaaaagtgtaacatgtccaaaaccgaatctcaatgccttcctctccatctctctcaccatcccctaacctgctcccccaaatcttcccatttgtgtaaatagcaactccatcttcttggttgctcaggccacagccagtggcatcacccttaaaccctccttttctcatgtctcacagtccatcagtgaaatgccatcacttctaccttaaaaatatgtgtcaactccaaccaattcccactgcctcccttgtgaccagttgggtcatgcccccacccttctgtgccctagtcctggtccttggaacacctgagtcatgtcacttctctgcgtcaaccctctagtggctctccccattcactcagagtgaaaagcagagtccttgaaatggccagcgatgccctcagggcccaaccctgtcccctgcctctcaggtgtggtctcgctcctctgtgccctggctcctggagctccagccacacgttctgctggtgtttggtgacagctgtccttcggattgccaggtgcactcctgcggcagtgtgtttgtgtttgctgctccctctgcccggaaagcacctggtgcctctataggaagtgtccttgacctccatcctcctcctcctgctgccttgttttccttctctgctcttgatgccattgcacacacctgcttgtttacggtctgtcttctcatggctggaaagtaagccccctgcagacagggactgtatgcttcttttttgtactcggctctgtccctagtgcttagaagagcacctgctacctggtaggcactcagtatttattgaatgatgagcacacctgttttctggcggtctgatggaacaagaggagcttgggggcgtggggctggcctgagttggaatcctggctctgccacttccccactgtgaagctgcaggcaagctgtgtagctgccctgagcttgtgcttccttgtctttcagatgaaggtaacaccttctttgtcataaggagtaaatgtgggtaaagcatcctatgtgtaattttgtttattattctattatcctggattgaaacatcatttccattatttttgtttttattattttcaacccaacagcacactttaaacttagatttttatgtttattattattttttctatatccaataagcaacatataaacttagatttttaaatgaatacatacattccacaataacagatcattagagctgctggaatacggaaatatttttaaaagcagtgtttaaaataaggcctcggccgggcagggtggcttatgccactttgggaggctgaggtggatggatcacctgaggtcaggagttcaagaccagcctgaccaacatggtgaaatcctgtctttacccaaaaaaaaaaaaaaaaaaaaaaaaaaaattagccttagccgggcgtggtggcatagtcctgtagtcccagctacttgggaggctgagacaggagaattgcttgaacctgggaggcggaggttgcagtcagccaagagcgcaccactgcactccagcctgggtgacagagtgacactctatctcaaaaaaaaaaaaaaaaaaaaaaaaaacccacaaaatatataaaataaggccggaagaagcataggaatgtttctaaaggacaatgaatgagatgctggacacttctcccattgataggttcatgttttggaaacttgttccaaagagaaaatgtcagggaaaagcaaatacagtcattccttggtatccttgggggattggttccaggacccactgtggataccaaaatccatggatgcttaagtccctgatataaagggtgtttgcatataacctacacacatcctcccatatactttaagtgatctctagattacttatgatacctcatgcaatgtaactgccgcatacatagttgttatactgtgtcattttaaatttttttattgttgtattgttaatttttaaaattaatgttttgaataactttttctgcacttggtaccatgcgcatattaggggccttctgctctccttcccgattcctgtcctctccaggcctgattctgtgcaggaaaatgatagggcttgagggaaggagcagcagaaagaaatgtagcccgcctgacctttccagccctggttctgttcctctgatttgaccttaatctttccacctatggtatgggaagaagaaaaatactaaaaaggaagtcagagagcagaagagagaaagaggaaatggtggtggacaaaaaagcaagtaattttccctcccaatattttactgtgacaatttgtaagcacacggggaggttctacagtagtacaggggatcccacagcagacaccatagaccaccacctaggtcctacagttagcatctcactatatttgctttataggaaatggatagatagggtttcactggtcaaaacaggaacactgagacaaatccactgaaagtagaactgaatacctgactttctttttttaaattttaattcgaattattatttttttaaaattttactttaagttctgggatacatgtgcagaacatgcaggtttgttacataggtataaatgtgccatggtgctttgctgtgcctatcaaccagtcatctagattttaagccccgcatgcattaggtatttgtcctaatgttctccctccccttgccccctacccaccaacagacccgggtgtgtgatgttcccctccctgtgtccatttgttctcattgttcaactcccacttatgagtgagaacatgcagtgtctggttttctgttcctgtgttagtttgctgagaatgatggcttccagcttcatccatgtccctgcaaaggacatgaactcattcttttttatggctgcatagtattccatggtgtatatgtgacgcattttctttatccagtctatcattgatggatgtttaggttggttccaagtttttgctattgaaaatagtgctgcaataaacatacatgtgcatgtgtctttttagtggaatgatttatattccgttgggtatatacccaataatgagattgctgggtcaaatggtatttctggttctagatccttgaggaatcaccacactgtcttccacaatggttgaactaatttacactcccaccaacagtgtaaaagcattcctatttctccacagcctcaccagcatctgttgtttcctgactttttaatgatcgccattctaactggcgtgagatggtatctcattatggttttgatttgcatttctctagtgaccagtgatgatgagctttttttcatgtttgttggctgcataaatgtcttcttttgagaagtgtctaaatacctgactttcaacattggcctgaactgaaggagcagtgaaagaaagcagggtgcagaggctggggacgtggacactcagggagggtgcatacactcctgtaaatcctccttgtggtatctgagcacagcccagaaagaagagaacctgcagtgtcatttgcgaggcccaggtctattaattggggtcctcttggttgcaaatgatgaaacattggcttaagcttgcttcagcagaaaaggaatgtactgagcagatcctaaggctcccatgtcactatgagcgggacaaaggtgcattttaacaaacccttcctgtgactctgatgtctgctcaagtttgagaagcggtgtccaaccataacatgttatccaccagtaacgaccagattatgttatgtctgatgattttagggctgtgaattcttttctacatctttgtggaattgagaggaatttcttagttactttaatctgtgaggcatttgaactttttccttttatatactttcttatacaggtggttggcagcttaaatatcagtgaagctgttaatgaagatacttactaaatagcaaagcagcaccgaagtgcacaccttcataggatcttctggagcaagccagaaatctcaagtggtgctgtggccaggaaacaaagcaaaaaatgcagtggtgaatagagaaggagcaagaattagtaactgagactggtagctttccttttgatgttgcatccaaaaagcagtgacaaagtaagagtagctaccttcagctgtttgttttgaaggacacgtgggatcagttttttgtctttatgtcctacccccaggaaaccttttaagctaccagtctttttcaaatggaattcctcgtggaaggtgcaggggaaatgaagtgctccccttgaaagctttgctgctacccaaactccatgccctatgggagggaggtggcacagcactggcctgcagcacatcatacttatcctgttgtctgggaaggacaggaccacatctacccacagtgcagcataaaatcccctagtccaagaggagacagagtcagctgagtgtggctggctcacaaaatggaacacaatagctgatgtgtgttatctctagctgtgcctggtgcatcacaggcaggcacactatgcatttttactgaatattgttcttggatggatttaccgaagaagagcctgaggttcagagaggttgatgacttgcttgatgttctattgtactctctggaatccccgttgcattgcgttcatttttcctaaaaacactcccctcctccctcctcctccttgccttaatttgaatttagtttttacaggataacaatagtaaaaacaataatgatgattttcatttgttatcgttatagttggtgtctgttcaatgcatactgtgtcagacactgttatcctaagcacactgcatggctaacttgtttaatcctcagagcaacactctgaagtgggtaccatgatcatacttactttttaggtgaagaaaccaaagcacagagaggacgtgatttgcccaaggtcacacagctaagcactggcagagccaggattcagacccaggtggtctgtattttcagcccttggccactaaactgtgctgccacgtgacatagcttttttcccaacccctgtgacgtgggatggggacctcctggctcctgttggtcttcagcctggtgttgctgtggaagacacccacccctccagaatgcctccctgccctctctgcctgagaaaaactgaatcatggcctcttctgtgaggtcttgggactcccccagcccctcctgggctttctccacattcgtttctctgcagcttagtgctgtcctcagtgtgttctgtgtggttatatgggaacctcctctttaggtggttaactctgatcggcagggcctcctgattcactttgacattcatgccatatgcacagcatacagatcttctaagtggacgtaggctaaagatgtacgtccagcctctagtgggtttttggtaaagcttagctgaattacagtgttcagaatgggagggacaggaatggagaagccacaagcccgacagaagcagccctggcaaagtgacaagaagggagggaggggtttggagctgtttctcctgccgatcttcccttccctctcccacatacatgtggagggctgctgcagtctccctaggagcatggcatcccaggaggagtgcccccctctctccccaggacgtccgcatcccccgtccacttcctcctggcactgaaatctggactttatctcactgcaggattcactgaaaggctgttggatggctggaatccccttcagcctttacagctaacatactaggtgttcccatattctaagggctcttttactgtgggtgagctggctggaggagaaggggagaggagaagggggacgagaaagggagccccaccctctgctcaggacccattgttcacattcttttccgtgtgaaatgttgctgcatccaggccctaggctatgagtggtggcatttctatgtttgtggaatgaatataaagtctgttttaggatcagtggacaaaaatcagcatgtttgaagtggaggttacaatcagttggttagtacgatatttgacatttaccctgggcccttaatggtgcagtttttctgatgtaaggagggtgaaaaagcagccactatgtgtactaaacagaaggcgtgatgagtacagtcagtgcaggatcgtgaaggcatcagcacattccttcttcagctaatcagcccagacagtgtggggtatttttgtattctctgctgtttgtgctctgagtacatgtgcacaaaatgcagtgacactgatcaataaactctttaagcctaataagcatatgcagtctcatagcaatgaggacataaacagggagaaggatcttaggtgattcaaattctcttttgttggccaggcacggtggctcatgcctgtaatcccgccactttgggaggccgaggcaggtggatcacctgaggtcaggagtttgagaccagcctggccaacatggtgaaatcccgtctctactaaaaatacaaaaattagctgggtgtgggggcacgtgcctgtaatcccagcttcttgggaggctgagacaggagaatcgttcaaatctgggaggcggaggttgcagtgagccgagattgtgccactgcactccagcttgggtgaaagagtgagactgtctcaaaaaaaaaaaaaaaaaaaaaaaaaagaaaaaaaaattctcttttggaggtgaggagactgagctaccagatccaaacctttccagggctccatggctcacaggttgcccgattcctaatacagcatggtacttcatgccctccttccaaaggaggatttagattttgtttgtaaatctaaagatgcttctgttgctgccagcctggagaaccaccatggagagccactaggaaaacagctgcaatgatgatgttgaagatgatgagagcctccaacatttatgttcttaataaaatgctttaaatttttaactaagggcacaactctagagatacgccaactgctttctcttttttttttcggtgggggggcgggagacagggttttgctctgttgcccatactggagtgcagtggtgcaatcatggctccctgcagcctcgaactccagcgatcctcccgcctcagcctcctgagtagctaggactacaggcacgcagtgccacaccccactaatttttaaaaaagattatttgtagaaatggagtcttactatgttgctcaggctggtcttggactcctgacctcaagtgattgtcttgccttggccttcaaatgttttctccattttagaattgaggaactgcagcatcagtacctgggtcatataggtaggaagaaggagcgctgctcccttcaccactccctgggctgcctccttcctgtgtgattgcagggaacctcctatatagagatcccagatcccaagtcttcttttgcatgtcccactccctccccacccttgaaaacaaaaacaaaccctgcgatgcagcacttactgctgactcctcaccagagaccccccagccctgagcatggtgctgcagctacctgtgctttccccccggtcactgctactgcttcacccctgttcttatcatgactggcgccacctatgttaccatgccaggtcctcttgcagtgcctcaaaggcaaaactcccactgcttgcgcactgctgtcttgtgttgcctccagctgtcatctcaccaagaccttgagtcccaggaaccaaccccttatggaagggggcagggcaagctctacctctgctgctctggggtggtggctggggatggaggctgtggtgggatctccgagggggtttcacttctgttcccagtaggagtgctctcatttgttggatttcctggtttattctgggtttcagagagcccttcctctcttggcctttgctgtagagtttgaaaattctgtactttgagtcagacttgcagattttagaaatgtcagagaatcagataggggaaaagcagaatccaccgtgtatggcttgcgttattgcgttaagaattcccttaaccactgtgatttccctttttcatttgagaagtcatctagggagttttcaaagtttcaaaccagaattgattttcatttggggaccagggaggcacctgagtgtgcttcttggaagagtgagtaatagtttttctctattgagaaaaagctgccaacattatagactatggtcatttaatattaaacatgtattatacaggtgacctgatggatggtttgagaggttggagagcttgagtgaagggatgctttttactctgagatgggaagtggaaagaccattacagagttctctaagaagggtagtagtgtaacttctggattaactcaagtgtcatgtttggtccatgatatggtttggctgtgtccccaaccaaaattcatgttgaattttagctcccataatccccacatgtcacaggagggatctggtgggaggtaattgaatcctgctgttctcatgatagtgaataagtctcaggaggtctgatggttttataaaggggagttcccctgcacatgctctctcttgcctaccaagagtatagtgagatgtgactttgctcctcctttgctttccaccatgattgtgaggcctccctagccatgtggaactgtgagtcaactaaacctctttcctttgtaaattacccagtcttgggtatgtctttattagcagcatgagaacagactaatacagtccagttgctaaattaggggactgtgctgttgttcagaaaatgtggtcgtgggccaggcgtggtggcccacgcctgtaatcctagcactttgggaggctgaggcaggtggatcacccgagatcaggagtttgagaccagcctgggcaacatgatgaaaccccgtctctactaaaaatacaaaaatcagccaggtgtggaggcacacgcctgtagccccaactactacttgggaggatgagaatcaggaaggcagaggttgcagtgagccgagatcgcatcacggcactccagcctgggcgacagagtgagactcgtgtctcaaaaaaaaaaaaaaaaaaaaaaaaagaaaagaaaaacaaaagaaaatgtgattatgctgacatctagtaactggagttgcacacaaatcatccttttaatgtgaattacttgtttttaaagttaataatttgttttgaaatcttgaccaagattgcatggctaatatgaagacatccaccatcaggctgggagtggtggctcataccgataataccagcatttgggaggctgaggtggaggattgcttgaggccaggagttcaagaccagcctgggcaacatagtgagatcctgtctcttcttttcttttcttttttcttttttttttttttttgagatggatagactgtttgccagtatagagtgcagtggcgcgatctcggctcactgtaacctccatctcctgggttcaagcgattctcctgcctcagcctcccgagtagctgggattacaggcatgtgtcaccacacctggctaatttttgtattcttagcagagatggggtttcaccatgttgaccaggctcatctcgaactcacctggctaatttttgtatttttagtagagatggggtttcaccatgttgacaaggcttgtctcaaactcctgacctcaggtgatctgcccgttttggcctcccaaagtgctaggattataggcatgagccactgcgctcgaccatgtgatcccacctctacaaaaatatttttaaaaaattagccaggcatagtgttgtgcacctatagtcctagctacttgggaggctgaggcaggaaagcccaggaattcaaggctgcaatgagccatgtttgaactactacactcctgcctgtgtaacagagcaagaccttgtctctaaaaaaacaaaaagacttctaccgtcatccctcttgttaaaaggcaatggcgagttactgtttaatgagtagactttatttgtgatggtaaaaatttctggagatggatggtggtgatggttgtacaacatggtgaatgtatttaataccactgaattgtgcacttaaaatggtgaattttatattatgcttattttagcacagtaaagttttaaaaattacaaaaaaaaggaaaaaaaaaaaacccagaaggctagtatttgcaggagtggaactaggactttgcctaaattgcaaacttccttcactccaattttctttttctgttttaatgaagcacagcatatttacaataaaatccataaagtacactaatcttaatcttagctataaagctcattgcatgtttatatttttttacacttgtgtaaccaccaccctgtcaatatgttgaacgttccagcaccccagaaggtttctttttggttgtaactccccgagaggtaaccactattctgacttatattaccatcatttgattgtgcagcttttaaacttaatacaagtggaatcaggcagtatatactcttttgtgtctgcttctttcacttagcataatacctgggacagccacccatttattagtatatcagtaattcatttttttcctatttgctgtgtggttctcattgcatttatcctctctgttgaaggacatttgggttgttctagttttgggctgctataaaaaaggtgctatgaacattcttttgagggacctatgtacttgcttctcttgggtgcggatctaggaatgggattgctgagtcacagggaactgtgcgtgctcacttaggagtctcccttcttcgacttactgcctttcagcaaatgtttgtcctacccctttcatgacagggaagaaagcaaagcaagagcagagggtgttgctttcttctattttccagccttagcgttagtagatactgccactttccaaagcagttatgccagtttacacttccactcacagggcatgagtgttccagttgcttcacagcctcaccaacacttggtattggtgtttattcactttcaaactatggtggggtgagggtggttacaccctgaaatttaaatgatgcaaagatggaaactttaaaaaattgtgcaaatatttaaacttctaactctcagtaaatgaccccaaagccagtggagtaggatggagcagggcttttcccttcagcctgtgtgatgggcggggctcgcccactgcatatcgacattgatttaagggcttttccttactgtgtgctctggatgtcagatacattagacagctttgggcagctgccttctccagtcttccggcactgttcctctccagagccttctttcatgaagacccaacagtagttgagagaattcagttgtggtttttctcattaacgttgaatgtaatctatctgggcctgaagtgtggatcacttaggagtctcctttcttagacttcagcaccttttagcaaatgtttgtcccatgacagggaagaaagcaaagccagaacagagggcgctgctttcttctgtcttccagcctccaagatttcctttctcacctttgaacacattttctgtgtcagatcatctacagaatgcttggtggtgaggccacagcagatactcagattgtttctctccctccacctcctcctggcctatgtcatgagcctttttttgttgtcctggaatttcttttgcattgccctaccctgccttttgtgcatctcccagttcttttttcattggttcccattctttttttcccccaccaggagagcagatttattttttatttaaaatttttgtttagagacgaggtttcactttgtcacccaggctggagtacaatggcacaatcatagcttactgcaaccttgaacttctgggctcaagcaatcctctcacctcagcctcctgggtgtcaccatgcccagctaattaaaaaaaaatattagcgagacagagtctcactgttgcccaggctggtcttgaactcctgagcccagcagtcctcccacctcagcctcccaaagttctgggactacagtcgtgagtcactgtgcccagccacattttttaaggctcattacttgaagtgtgacctgatggtattcttcacgcacagtcttagacactgctctttgaaacagtcatgggagatcatactcggacctgttatgacagaaacaggtttgtgtagctttgcattttttcacttcactctatcatgctactcaaagtgctgttattgtatcttgactgctgggcacatagcccagctcccatgctctgcttgtttatagcgctccttcctgaaaaccacctcttcatcctctctctttccttccaactctctcagctcaagagggccagcagtgaggacacgctcaacaagccaggaagtaccgctgcatcgggggtggttcgcctgaagaagaccgccactgccggagccatctcggagctcacggagagccgcctgaggagcggcacaggtaggagggaccgggcaggtgggctcggcaggccatcagtcctggccgcatggaagcacttcagtgacccatgacccatccattccttccctcgtgaaatatttcttgaccacttaccctgggccggaactgttttaggcagacgatgtcgctgcccacagggagtttacatctatagagtggggagaccgatgagaagcaaaaggtaactgggcgtgctgtggtttctttggtcccttcggaggtccatttgtcaccatgcacgtgtgaaatccttctgacatccaagcagggcggcatatgttctggggctgtcttgatacagaatgcattagaggaatgaatgaaccctgttgatcccttgcgaaggtgggtgtctaatatttgtactgaaccctatggaaagctgggaagagcctcgcccagcagctgtggaaggctgctcagagtggcttggacggcagtggcaacaggaagctgtgaaccttctcagtgttactcattttttaagaatcagaaaagggtttttcaatcattatatttgagttcagagcatgtgaaacatgaaatatcaaagaatttatttaattctctctttgtgcatatagataataactcttaagctttcatggcctaactcttacagtgcagccctcagtgtattgctaaattgtctaagacgggaaaaataactgaaatacatcgttactaatttttaatgtgttgaaggggcacttataatttttgtgctcttttcgtaaaagtcacattcaggctagatctcaaaaggtatattttaatttatcagtttttaaaaagttgaatctgtgaaaaccatacaaggtattcttttcttggatataaagggaatggcctggtttttctatataatggctttaccattgtaaatactgatattgtattaaacatacacacacacttggtttttaaaatacaataaacaaaagtaccatttatttttatcaagccagcctaacagtgatcccaaaagttaataaagccccactcaaaaaaagacagactgggaggagcctaggggcagggtgggaatgaggaccagccgagtcccgggtgtgggacaaattgcgtgtgtgtggtgtgtccccaaaagcaggaaggtggcgaaaggaggcgaatcccagtgggtggagggaggggaaaggcggaaggagaaaaaggtgggaggaggatcgggtgggagggtggtggctcactcaggacccagggggggggcagcgcgatgaggtgggtggccctgttcctgaacggcagccccaagaagggaaaggtggttgctgtatgtggaactttatctgatttgctttctgtggccagtggtaaacttggcataaaagccaccagtgtgtataatggcaaaggtggactgattgatgatattgctttgatcagggatgatgatgttttgtttgtgtgtgaaggagagccatttattgatcctgacagattctaaaccacctgagggattgtcaggattccacatagactggctaacattaaatgctggaggggcggtactttacaaccacacagagcactttagtgaataaagaacctgatagtatgctggcccacatgtttaaggacaaagatgtctgggaaataagcaagatcacagaggagctttcttaattgaccgaagtcctgagtactttgaacccattttgaactacttgtgtcatggagagcttattgtacatgatggcattaatttattggatatgttagaagaagcaagattttttgtattgactcattgattgaacacctagaaatggcaataaagaattctaaaccaccggaggatcattcaccaatatcctgaaaggaatttgtctgatttttgctggcaacttcaatcaagtcagaactgcgatgccaaggtttgaacttcagtggtgctgatctttctcatttggacctttgaaacattaacttcaaaatggccagtttaagccgctgcagtcttgcacatgcaaatctttgctgtgcaaatcttaaacaagctgatctctctggatcagtgcttgactgtgcaaatcttcagggagtcaagacactctgttctaatgtagaaggagcatccctgaaactgtgtaattttgaggatccttccggtcttaaagccaatttagaaggtgctaacctgaaaggtgtggatatggaaggaagtcagataacaggaattaacctgagagtgactaccttaaaaaatgcaaagttgaagaactgtaacctcagaggagcaactctggcaggaactgatttagagaattgtgatctgtctgggtgtgatcttcaagaagccaacctgagagggtccaacatgaagggagctagatttgaagagatgctaacaccactacacatgtcacaaagtgttagatgagaattttaggggctggaggaacatgtacaagatgaaaatgttttccttatcacttttctttctccacccgctcagttgtctagaagaaataacactgtaaggaagttaaaaaaaaatttagaggattatgcttgttctcagtggtgcataagggaaaaaattgacttttttttccatattctgatttttaacagaaaagcactcatttaatagatatagggaaactagatattgctgccttttgaacagggtaggggggtttacctggttttatgaccaggaatagtatctattacatttgcttttaaataggcatgatgtggaaataccatcttggtttgagatgcatttgaggattttaatttatggaaagcacaacatatgcaatttatatttattgaatactagatgcagtatggatatttaaattgtaaaaactttacgaaaacttggaaaaggttgttcaggtttataaatagctttagtgatgcctccttctttaaatacttgtcacagcatatgaatatggtaagatcagactccctaagactcttcaggttcatttttataatgtttactttttagaacaaaacagtagctaaattacagtaatatccagttcttactgattgagacagagtggaaagaaagacatcgttgtacatcactgtcattccaaaggtacagtggaactccggatggaggaagaacttacctatcactacaacacttataaatgagcatttctcagaatgtcattctaggcaagttccactcaacaccagaccaagcaattctgtctattcacactattagcctagttttctcatacaatcagcacaagcataggaagatacttcaaaaccaaaaaaccaaggtgcaccattaatattcatttaattcaaataccaaatagttttacatagggccatcttagaaatagatattaaatccagatctactgcaatcaaagcttacacaatatgaatgaatatggtagagttgcctgttaaaaggcaatgtaatataattgctgctagaaccctacagtggggaatgaggaattttaaacatatatttgattacagccaccaaaaaagtatatataaagaaagtaaaaataaaggcatttggctggtccaagatgtaacaccaatcagtcagcacctatgattcttttacttacattttttactttttgtttttgtttttgtttttttgagacagagtatcagtctgtcgccaggctggagtgcagtggcgcaatcttggctcactgcaacctccgcctcctgggttcaagcgattctcctgcctcagcctctcgagtagctgggactacaggtgcacaccaccacgcccagctaatttttgtatttttagtagagacagggtttcaccatgttagccaggatggtcttgatctactgaccttgtgatccacctgccttagcctcccaaagtgctgagattacaggcgtgagtcatggcgcccagcctgtttttttttttgtttttttttttagtgaaatttagcctgtttttcttgagtcattttctctctgcaacagtagaggaagggcctgtatctccctaccaatgacctggtgtccttacatctaccccaagagcagggatgttagctgtgtccacagggttctgaattctacagactcatcaacatgaggcaaggaatcattgaaaaccacttttgtctcctttgggagaatgactcatctttagtatttatgtagtgtattcttctatatctacatatgcaaagctttctttgacagtaaagggcacatatgcatagtgggagaagatcagacctttacaagtgaaggaaagcaacttcagaaatgaattattttctttgctttattatttttaccaagacagagaagtattgtattgagagattatctattttcataatcaacatttgcctaaattatatttaaatcatttcactttgtactatattttcaggaattatagaatgtgttattcactcacttaaaggtacctctgtagaaataacctaaaactgcagaaggatccgaaagatataacatggtgtgtttagaaactgcagattttagatctaatgtatactgcattaataaatgatgtaaagtgtggaaaaggaaaaaaaaagactgatcccatgatcaaatattaatataaaaatttgagatcagccgggcacggtggctcacacctgtaatcccagcactttgggaggccaaggtgggtggatcatgaggtcaggagatcaagactagcctggccaacatggtgaaaacccatctctactaaaaatacaaacattagctgggcgcggtggcgggtgcctgtaatcccagctactcaggaggctgaggcaggagaatcacttgaacccgggaggtggaggttgcagtgagccgagatcgtgcaactacactccagcctgagtgacaaagcaagactgtctcaaataaataaataaataaataaataaaaataaaaaaaattggagatcaaaatattagtgcataggattcaacaataaattaaaagaacagtagtgtacatcacaactaagtgaatttatgccacccaagaatggatgaatattaagaaattttggaatataatctatcataccatattaacaggccaaagaagaaaaactgtagttatctctatagatacagaacatacatgtgacacaattaacaatctttctaacaacaaactcttgatagactatacatgtgcagagacttctttaatgatgtgtatgtgtcacaaacaaaagccagcgattcccattaaagtcaaagataattcaaggttgcttactatcaccagtcatctaaaattttcggtagatactaaccaaggcagtaagataagagagatgtagaagtacataaatattggaaatgagggaacaaaatgatgattgtaatcagataataacattgtatgctttgaatttcctgaaaattgtcttagaattttctgaaattctattagagacaataagagttctgtatgtggctagttgtagactataatatatcaataactttcttttttatttattttatttatttatttttttgagatggagtctcggtctgtcgcccaggctggagtgcagtggcgcgatcttggctcacggcaagctccgcctcccagtttcacgccattctcctgcctcagcctcccgagtagcttgggactacaggtgcccgccaccacgcccagctaattttttgtatttttagtagagatggggtttcaccatgttagccaggatggtctcgatctcctgacctcgtgatccacccaccttggcctcccaaagtgctggaattacaggcatgagccaccatgaccggccatcagtagctttcttaccagtgactagaaaagataataatgtaagaaacagttctatttataaaggaatgaaagggcaaaatatttagaaatagtgtgagcatctataaaaaaaatcttaaaactcttttgaaggagaagtcttatgtccttcaaagaagacataaataagtgaaagcatatatgtgattcttaggaagattaaatagaattaagattaaacttagtacaagatataaaatgtaataaggatgtctgaattattctaagaattccttttcatcttgattcagtgggaatttgggagtggaaacctgaataaaataactggaatttatctaaaacccgttgttctcaatgggggacgattttgtcccccagttccaacccagggaacaattggcagtgtctggagacttttttttttttttttttttttttttttttggctgtcatgactcggggctgctactgccatctagtgggtagaagccagagatactaaacatcctaggatgcgcaggaccgtccctgcagtggagagtgtcctgcccaaaaatgtcaacagtactgctgctgagaaatcctgacctagcagaataaatattctagagtaaccaggaaaattctgacaatactaatcaggggattaaccttaggcattctggaactgaagaggtgctaggcagctcagtggaacggtggacaaagtgcagaatacactggaagatttagtacaggggaaaggtggcatttcatatcacggtggataattcactcaaaaatgtgaccgagtaagtatttaggaaggaataaagctggatccctatctcattcctcccatcaaaataaattctaggaggattaaagatttaaatattaaaaaatgaaactgcaagactacaaagagaaagcatcagagaattaatttgtagtcttggccttggaagaacctttctaagtaggaacagacacagaagccataaaggaaaagatgaaaaatgtacttacataaatataagaaacttctttgcaaaaagaagaaattatttgcaatacatgtaacaaaatgcttatttacaaagagtttatacaaatcaataagaaaaagaaaaataggccagatgtggtggctcatgcctataatcccagcaatttgggaggccaaagtgggaggattgcttgagcccaggagttgaagaccagcctgggcaacatagtgagacctcatctctacaaaaataaataaataaaaattagctgggtgcgtgcctgtagtcccagctgcttgggaggctgaggtgggatgattgtctcaaaaaaaaaaaaaaaaaagaaaaggaaaaataatataatagaaatatatatagcgcccatgaaaaatacagatggctagtggaaagatactaagccttacttaagaaatgtaaagcaaggctgggtgcggtggctcaacgcctgtaatcctagcaccttgggaagctgaggcgggctgattgcttgagcccaggagttcgagaccaatctgggcaaaatggtgaaaccctgtctgtacaaaaaatacaaaaattagccaagcatggaagcgtgcacctgtagtcccagctagttgggagacagaggtgggaggatcacttgaacctgggaagtgaaggttgcagtgaactgaaatcatgccactgcactccggcctgggcaacagtgagaccctgtctcacaataaataaataataaataaataaataaataaagcaaaacaacaattagatatataatttccgctaatacattagcaaaaattaaaacagtttatcatttctggtgtcattaagggtgtaaagagccacatatggttgatgcacaaggacaagttggtaatatctatctaaatcttaatttaatctttcaccaagcatttctattatttagcacttaacggttactgatattcttggaaaaggatgccaacatgtatgagcaagttcagttgcatgattatttataatagtataatatgggaaacaacctaagtatgtattcatacagggctggttgaacaatgtgattttggtgcagtagaatagtatacaggcatgaaaatgaatacagtagatttgtgtgtactgatagggaaagatttccaatatacattactaagtggggaaaataatatggtgcatatggtataaccttaatttggttttggttttagaagtatatattaattattaaaatcaacttttttttcctggaaggatgtcagaatgattatctttgaggagagttagcagaattgatagtggcagaggaaaattttttcattttagattttcctgtgctgtttgaacattttaaacatatgcatacattgctatacaaaattaaaaacaaggtaaatacaacataaatttagacaatataaatataaactaaacttttttttgccttcacaaaatccttcctcttctacttgccttttgtagtgttctttagccatttgttggtggatttttttttattgtttgcttatagcatctgctcctttgcacaggattctaggaaaagaccttggtttcatattggctcctaaagtagacaagttcccatgccccaaggggcattggcatcctttatttgtcaaaggaaggaaataactacatatctactatacagtgatgttgggaaaaaggtctgtgaataatttatatagactgtaatgaaaagtaagtgacagttattattctcctagttatacaaattgtttgtcagttacttcatttaagtgaaattaaattatttgagttaatagggttgaatttgaaaattacattttgtttctgaagcttttatttttttaaatttattttattttttgagacggagtttcgctcttgttgcccaggctggagtgccatggcgctccacaacctccgcctcctgagttcaagtgattctcctgcctcagcctcctgagtagctgggattacaggcttgcgccaccacgcccagctaatgttgtacttttagttgagatcgggtttctccatgttggtcaggctggtcttgaactcccaacctcaggtgatccacctgcctcagcctcccaaagtgctgggattacaggcgtgagccaccacacccagccaagagcttttatttttaaatgtcagtagtcctcaacatttttgtagcacctttggacagctgatacttttgtacattgtcatgctgtccccagactgcctcatttggaataggtgaataccagtctattaggacagaccattaggagcagtggtatgcagtgcctgtctgttgcaggtgttatcacctctacagttgtatagtattgtttcggtaatcatttcaatatttgattgcattttgtctattttacatgcgtgaaaacgaggaaaatgaaagtgctggttgggattacagcaactagttgtacaggctgaacatcccaaatccaaaaattcaaaatcccaaatgcttcaaaatctgaaatgttttgagcactgacatgatgctcaaaggaaatgctcactggggcattttggattttggatttttggattagagatgctgaactggtaagtataatgcaaatattccaaaataaaaaatcagaaatccagaacacttatggtcctgagcattttggataagggatactcaccctgtagtaataagcttgggttttaaaatctcagtactgccgggtggggtggcttatgcctgtaatcccagcactctgggaggccgaggcaggcggatcacctgagatatttggagaccagcctggccaacatggcgaaaccccttctttactaaaaatagaaaaaaattagccaagtgttgtggcgggtgcctgtaatcccagctacttgggaggctgaggcagaagaatctcttgaacctgggaggtggaggctgcagtgagccgagattgtgccactgcactcgagcctgggcaacacagtgagactcagtctcaaaaaaaaaatacagttgatacaaagatggaaattatttagtgtgttagaaattagatgttcactggacttaaaccaattttctataggctcagctgtgaaggaaaagaataaaattaaaggaaattgggggacttctggcaatatatagttgatttcctttcagaggaaatttcttttcacaggaaatcaactatatattagacttgtagggggcagaattctttttatgccatgcaagacttagtttttgtacttttgacttggggacaagttttctacgatgcatagcatggtattatctatattttatttcaattgtattaattttgagaaagatttttgtcatgaaattttaatacagtgttgtgattttgaacttacaagaattaaatctatagtcagcctatattttattgcaccctttcctgggagctgatctgtcctcagggagaatccctgaaatctactccaggagaaatcatgtaatcttttggtcgtaataattatattattgtctcagccttgcctagggcgccaacttgccatctgtcatgggtggtattggaactgcttgaatggggaggcatgagcttcctcattcttttcaagactatttccagtttctggtttccaggccttatgctgttctctggggctatgccaaagtttgctccaacaatagcaagaacacagcaaaaatcacaaaaggggcttctatttttgagccctgccacctgcctgcactgtgccggcttctctgagctgctgtctctattcatgctcacaatagccataggaagagcatggttattttatctagaccaggaaccttggctttggaaaggtcaaaccagttttactttttctctcccgtgcccaccacaggtttccatatggaacatccactttttctaattggttttatttcattaatattattcacttatctgaattccaaaaaagaattctgaattcttttttttgttgttgttgttttttctatagacggagttttgctctgttgtccaggctggagtgcagtggtgcaatcatagctcattgcagcctccaacttctgggctcaagcaatcctcctgccccagctctcgagtagctgggactacaggtgcacaccaccggggtctcgccatgttgcccaggctggtcttgaactcctgggctcctcctgccttggcctcccaaagtgctgggattacagacatgagccactgcgcctggcctggattccagttcttattattctttttctccctgaggtgtcctttgtgtgtatctcatgttacacagtggtgtggcttttagagaatgaggaggttccttgtgtgcagggtcctccctgcctgccccagggtcaagtgaaaggttgtggaacccccagaaggctgtcaaggaatccagccactaggtggcagccttgtcaaaagcacccaccttctcctctgctacaagttctggttctgacaaatgtttctgactttagaaacaatgcttgtatttattgattaattcaacaaatatctttgagtggctaccatgtgcctggcactgttctaggcaaaaggactatatgagtgagcaggacaaacatccctgccttcataaaggtacatgagcaagacgtgggagagatgagaaagccaggtgaacagctggagtggtggacattccaggcagagatgacggctggcccgtgtcccccacgtcaagggagtggcaggaagaccagtggggccgcagcagagtgaacaagcagttggggaggaggatagaaagatgggggagcttgcgagtcactgtcaggactttggattttttactcttgactccactggggaacttttgcaaggttttgcacagagcagtgatatgacccaacctcattttaaaaggactgctttgggctgcttgttgagagtggacagatggggtaagcagaccagcttggaggctagggctgtggtctaggaaagaagtgacctgggctgggctggcagccatggcaccggggaacagcagctgcgtctggatatattctgaaggggagagccagctggctctcaactttcctggtttttgaattgtggaaaaatacacataatcatttttaagtgtacagttcagcggcattaagttcattcacattgttgtacaaccatcaccaccttccatttccagaactgtttcatcttctcaaagtgaaactctgtccccattaaacactcgcttcccattccccttccctcagctcccggcaagcaccattctgttctttgtctctgaatctgactgctctcagttcctcataggagtggcatcacacagtgtttgtccttttgcaaccggcttatttcactcagcataatatcctcaaggtacatccacactgtagcatgtgtcagaatttccttcgtttttgaggctaaataatatttccttgtctggatataccgtatcttctttatccattcacctgttgaaggacccttggcctatttctaccttttggctattgtgaataatgctgctctgtacacaggtgtacagatatctccttgagacactgctttgactttttgagggtatatacctggaagtgggattgctggattctcctgatggattgtaaagttggtgtagggtaagatttctgctcatgttagcagtgggatgagtgagatgaaatctgatgggccttcccaagggatgaggagtgaacgtggatctcttctggagacagcagtcggctagaaggaggttcatgtagccacatttaaaacatttttaaaaccacgagacatggaagtgcccatttagatgtttctttatatagcacacgtgggatccaaagacatgtcactattttaaactgatatcagtgttttctaaaaggcaaaataaatgtgaagggctagttttactgtggccaaactctgatgcttgcagaatctcagacatctcagatggtgatcagtaagggcaagcagtcgtgattggctcactgccaagaaactgtcagtgtcctcgctgatacctggacccctgcatgctcccagttacctgcatcacaaccaggtaatgcctgaggctccaacctgagacacctgtcctctctgacatgaggagggaataactctgtcctctctgacatgaggaggggaactcgtctaacatggaaggtaagtattcttatccccatctgacatgtgaagaagcgaaagctccaggataggtagtgttcccaaattcaaacccaggtccgactccagagttcttttttctgctactctgtttgtctcaggtagggagacttgttttcttccctcatcatctttacctgttgtagaattactattaccggtgactagcattctttgctcactatgtgctaaccactgttctcagtgtgcgatgaatatggtctcctttagtctttactacagccctatgaaatagtatccttattatcattcccattttatagatcaggagactgaggcataaagagattaagcagactgtccaagtccatgggatataaatattggtaccaggacttgcagattaggaaacaggggctgaaagaaaaccatggatgggttggcttgctggggtgagagtggaggaaggggatgttggaagttttggagttgagaggccggaaggtgggtgggtcagtttcttggatgccacagaaggaggagggccatgagccagggatgtcagggaatggggagaatggggtggggatgtgtagatggcaacagggaggggaagaggatgccaggtcctgctgtgtgaactgcagaaatggaaggtgtctgtttacagtggggaggggaacagacggggggaagcaacagtcataggtatgaggtacagcgagaccttcagtttgggaaatgtgagaaaatgaacagactggccttgggaaggcagtggtgggattcatccagctgtggaagtgaggggacattcagagagctcagcctatgggaaatgttgatttcactgtgagttctgaagggccctgaagaagtgttggggactcaagggaggggcctggggcaggtggggctgaatcgctttggagatgagaacctggaaaatcacagaatgccaggaatgagtttgttcttgttttcataattttagagaggtcatttatcaatgagtatattttgtgataaaaaaaatttcagattcggtatagatgctcctccacttacttcatcggttacttccagataaactcatcataagctgcaaatatgctaagttgaaaacacatttaatgcacttaaccttccgaacatcatagctgagcccagcctgctttaaacaggctcagaacactcatatgagcctacatttgggcaaaatcatctaacacagagcctattttataataaagtgttgaatatcttacataatttattgtattagattggtgcaaaaaagtaattgtgatttttgccattttaaaaattgcaggccaggcgcggtggctcatgcctgtaatcccagcactttgggaggccgaggtgggcggatcacgaggtcaggagatggagaccatcctgactaacacggtaaaaccccgtctctactaaaaatacaaaaaatcagccaggcatggtggtgggcgcctgtagttccagctactcgggaggctgaggcaggagaatggcgtgaacccgggaggcggagcttgcagtgagccgagatcgcgccactgcactccagcctgggcgacagagcgagactccatctcaaaaaacaaaaacaaaaacaaaacaaaacaaaaaaattgcagttacttttccatcaacctaatttactggaagtgaaaagcagaatggttgtctgggcacttgaagtacagcttctactgaatgcgcgtcatgtttgcatcaccttaaggtcaaaaagggtaagtcacaccatcataagttcggaactgtctgtattttcattttcttctattttattctacatttaattcattttcacattgtggtaggagatctaccctctgaacacatttttaagcatgtaattcaggggcaatgctgcatagcaggtccctcaagcttacgcatctgtacccactgaacgactccctgtcgcactgtctgcagcccttggcagccaccactcaactttctgtttctgtgagtttgactgtttgagattctgcatccaagtgagatcatacagtatccttttgggactggcttatttcccttagcatagtatccttcaggttcatccacaatgggacatgtgtcagagtttccttccttttaaaggctgaataatattcgatcgtctggatagccacactttgtttatccatcatacatggatggaccagactggctttcagcttctggtggtgtctgaggtaaacccagttgtgaggatgttatgaactctgcactagttaaggtgctgaattctaagcttgaggacacacatggtggtgtcgtggccctgcgtttcccgggagtacatgatttagtcagggctttggagtggggccaagggttttctgtgactttctctgttggcacaaggtgcagtgctggtttggggatggcagctctcctgggtcctccctgggtgcctgtggtatagacagtggggagctctccctgcacctccccgaagaatactgacatctttgccaactctttccatccaggtcctggctgtctctccagttctccatgtcctctcttccttttatttgggctcttcccctgaagtttgctatttcctttctccctccttccctgctctcctctcctcctttcctttttgttgagtttatacctttgtttatgccttccctcccttcctctcttcttctctcccttcattccttccttcctttttgttgagtttatgcctttgttttatacttttattcctattgtgaatgggattctttattcattgtactttgttcttattttctaacatatggactatttcacgactttgaatgtcatccttacacaggaaccatgctaatcttctctgcatcattccagttttggtattagcactgtcactgactatattttctaattagatactttaaaaaatatttagtttggaactggctcgctcccttaccatcctctcttcttagcactaatggttttcagttgattctcaggtgtcttccaagcagacagtcatatcagctgcagataacaatgccttttgtctcctccattccaggagttattcttttatttctggttcttgctgttttgtgcatgtgtgaccccagttgtgttaaatgctagtgacatcttgacttgctctcactttactgtgggtgattttggtgttttctgattaaatatgatgcagaaagttggcttggggctttgttttacatgttaagtcttctcctcctatattcctttgagttattaggatttggtcatggcttttattaaatgccttctaggcatgctgttattactttgattattgcttctctttttaccctggagtctcctccaggaaattaaagtatgtgtgtatttggtctcctgggtatttcttccatgtcacatatgttatctctgattcttgtgatcactttcattcatgctctgatttttcaaagtttatcatctaatgtgctttgctttgtatgtttcttttcttcaactattatgtttttaatctttagtctgatttctgtgctttcaaattatttcttcatgacttcttgctcaactttcatagctatcaaatcttgaatttcaaatgagaatgcaaattgcagatttttttgaaatctcccatttctaccagtaactttgtttcataggtgcatatttacttggaatcctcagctgctcccccttttatgatctgccagagctttccagatagatctagagagttttctgtgatcacctatctttacagagggaagctagtattggtccaaaaatcagaaattgagagggatactactggagaatgtgtggttatcaggtcatctttttttttttttttttttttttgagacagactctcactcttttgcccaggctgaagtgtagtggcgtgaccatagctcactgtagcctggagctcctgggctccagcagtcctcttgcctcaggctctcaaagtgatgggattataggcgtaagccacagcgcccagccaggtcatatcatttacgctctgtcgaaggaagaggaaaaatttttgcattatctggggtgaaagtaaggagggcattaaagcctgaagtgcaattttgccatttttttcttttctatgtattttgtttttgttgttctcattgttactttagtgcctgttggaaggtggccttgtcctccccttctgcttgcatgatggcccctgttcttatcagctggccatggctgtttcccttgtgtggccttctgtgcatgcaggcaaggagaagggaacactagcaggccttctgaagctgctcatggcagaggcctcaacttagtagtccagttacccttttaaatgatgacgattctgtaatgtgccctttaatatcctaaaatgaaattcaccagtccatatacattactgaaaaaaatcaatataatgctgtacctataatgtagagaagaaataaaaggcaaataatttctaatgaagtgacatatcagtgtgtaagtgctggagcctgactccactagaagacagatgcttgtacattagtggagattgctgccttaagcttgaatgctacaaatgagactgactcatgggtgcagtgttgagaattcaaataccaggcgtgttgacatcagtgactttgaaatgttgacagctcagggtaaacattttgaataaagcaaagtactgtctttccttaagttacatgatagttgcattcctagaaaattcagtgtataatagcaatgctgtgtgaaactgctttgtgtttctctgtaaaacagagttagattctggatgtaggtatttataactgtgttctcctattcaggagtgctgtcagatcacaaggagggagcaggaagcaggaagcaggcgtgcccctcatatttgcaaggcttggggcaagagtgcagcgggggccatctgtttattcacaatattctgatataattaaatattctagtaaaggagatcaagtgtcagggatttcagatgacctggtagcttgtcgatctaatgacaataattttcttactcattttcatcttttttttaatcagtaatgggtgaattttgtgtggtgaattttattttttcttcccagcttcccccaagttctactttagtattttctcatttttatcactttgaaatttgtaattcttctcaaaggttaaaaaaattaatgatattcaaatataattttaaaataatttttcttcaaaatagaaattaaagtcaatataaagggtgaaatatatttcatatttttaaattttttaatttaattttttatttttagagacagcgtcacactctgtaacacaggctggagtgcaatggcatgatcatggctcagtgcagcctcaaactcctggcctcaaacgatcctcctgcctcagcctccaaagttgctgggactacagccatgcgccaccatgcctggttaattttttaaatttttttgtagagacaggtgctcactatgttcctgggctgaagccatccttccatcctggcctcccaaagtgctgagattatgggtgtgagccactgtgcctggcctgttttgtttttttttgttttttttttttgagacggagtctcactctatcaccaggctggagtgcagtggcaccatctcggctcactgcaagctccgcctcccgggttcaagccattctcctgcctcagcctcccgagtagctggggactacaggcgcctgccaccacgcccagctaatttttttgtatttttagtagagacggggttttaccccgtgttagccaggatggtctcaatctcctgacctcgtgatctacgcacctcggcctcccaaagtgctgggattacaggtgtgagccaccgcgcccagccagatttcttttttttttagctgttgaattttgtgagttctttatatgtactagaaactagttctttattggatatgtggtctgcaaatatgttcttccagtctctcttttatcttttcaaccttataacagggtctttcacagaccaaaaattttaaattttgatgaagtccaacttgctaattttcccttctatagattgtgcttttgatgtcaaaattctttgcctagagccagttttgttgttgttgttgttgttgttttgtttgtttgtttggttgttttgagacagagtctaactctgttgcccaggctggagtgcaatggcacaatcttggctcactgcaacctctgcctcctgggctcaagtgattctcctgcctcagcctcccaagaagctgggattataggcttgtgccactgcgcccagctaatttttgtatttttagtagaaactgggtttcactatgttgctcaggctggttttgaactcctgacctcaggtgatccacctgcctcagcctctcaaagtactgggaatacaggtgtgagccactgcgcccagctgcctagagccacttctttaagattttctcttatatttttcccgaaagtcttatagttttacatttacatttaagtgtgttattcatttttagttaatttttgcaaaagttgtgagacttgggtcaaggttacttttgttgtggatgtccagttgctccattgttggaaagggtatcctttctctattgaatcgcttttctacttttgtgaaaatcagttggggctgggcgtggtggctcacacctgtaagcccaacactttgggaggctgaggccagaggatggcagcctggacaacacggcaagatcccgtctctacaagaaataaaaaaattagctgggtatggtggtgcacacttgtggtcccagctacttgagatgctgaggtgggaggattgtttgagcctgggaggtcaagtctgcagtgatatataataacgccattgcactccagcctaggtgacagagcgagaccctgtctctattaaaaaagaaaatatcagttgggcatacttttattctgggttctccattttgtgttgttgatctatatgtctgtccctctgacaatgcctcatactgttgattatggtagctttgtaatgtcttgaaatcaagtagactgattcttcctactttattattttccaaaattgttctagctagtctagttcctttgacttcccatataaatatacctacaaagaaatcttctgagatttgatagtaattgtgttgaacctgtaaatcaatttggggagaattcacatgtttttactatgttgaatctcctaatccataaacatggtatggctctccatttatttagatctttgatttctttcatcagcattttgtagtttgcggcatacaaatcctatacctgttttgttagatttacacctaagtatttattttttatttttgaggaattgtaaatgatactgtatttttaattttggtgtttgtgtgttcattgctagtatattgaaatgcaattgatatttatatgtttgccttataccttgcaactttgctaaagtcgcttattagttctaggaggattttttgtttgttttagattccttgggatttttcaatgtaaacaatcatgtcatctacaaataggtacagttttatttcttcctttttcttttgagtcgttttcttcctctgttgcccaggctggagtgcagtggcatgatctcggctcactgcaacctctgcctcccagattcaagtgattctcctgccttagcctcctgagtaggtgggattacaggcatgctaatttttttgtatttttagtagagacggggtttcaccatgttggcgaggctggttttgaacacctgacctcaagtgatccacccaccttgacctcccagagtgccaggattacaggtgtgagccactgtgcccagccaggacagttttatttcttcatttctgatctgtatgccttttatttccttttcatgtcttatcacactggctagaaagtttaacactatattgaataaaagtgctaacagtagacatctttgtcttgttcctgatctacgtggaaagcattcagtcttcttctttttttttttttttttttgcttttttgaagatggagtctcactctgtcacccaggctggagtgcagtggcacaatttcggctcactgcaacctctgcctcccgagttcaagcaattctcctgcctcagccttccaagtagctgggattacaggtgcgcaccaccacgcctggctaattttttgtattttagtagagacggggtttcactgtgttgcccaggctggtcttgaactcctgagctcaggcaatccccgcccgccttggcctcccaaagtgctgggattacaggcgtgagccactgcatccggccaagcattcagcctttaaccattaattatgtaatgttagctttcgggagtttctgtagatgctctttagcaagttgaggaatttctcctctattccagtttttctaagatttttttttttctgagaaatgtccctctattccagtctttaccatgagtggattttgaatttgtctaatgttttctctgcattgatagatgtgattatgtgacttttcttagcctgttaatatggtagattacattgactgatttttcagatcttgaacctgccttgtaccctctaaagtccacttggtcgtggtatatgattatttttatatattactgaattctatttgctagtattttgttaagaatttaaaaatctgtattcatgagggtctgtagtttgcattttttgtactgacattttctggttttggtatcaggataatactacttcataaagtaaactgggaagtattcctaacttttctttttttctggaagaaattaggtaaagtttgtgttaattcttcgttaaataattggtagaattctgagtgaaatattctctacttagaagtttgtttgtttgtttgtttgttttcatttttttttggcttttttttttggtgtgaaagggtgagtttaaaaaaatttcaaattcaaatttccctaattgttatagggctactcatattacctgcttaatattgagtgagttgtatttttcaagcagttggtccatgtcttctaaactgtcaaattttatgtgtagttatttatttatttatttatttatttatttatttatttatttgttgagatggagtctcgctctgtcacccaggctggagtgcagtggcgtgatctcggctcactgcaagctccacctcctgggttcaagccattctcctgcctcagcctcccgagtagctgggactacaggcgcccgccaccatgcccagctaattttttatatttttagtagagatggggtttcactgtgttaggcaggatggtctcgatctcctgacctcgtgatcctgccgcctcggcctcccgaagttctgggattacaggtgtgagccaccgtgcctagccgtgtgtatagttattcatattatattcccctttatcctttttgagtctgtggagtctgtagtgatatccccagtttcattcctgccattggtaatctgtatattctttctctttttttgtcagaagtttgtcaattttataattttttttcagaaccagctatttgtctcactcgtttttctctatttttttttcccatttcaccgagttctgctcttctttattatttccttatctgaaaaacagagctagtcttacccatctcctacagtgtgagaattaagtgaaatgacaaatacacgtacctaggacagaagcagaagtgtagattattttgtaaaatgtgatttttttcccccttgaactagctcccttaatagaatctcctacttaggaatcatggcagttaaaaaaaaagaatctacctgccttagtgtggtgtaccttgcccagtgtttcaggctttgctttcttaagatttttcttttttttttcaaaatcacacttgactcatgttatgtctagatttacatatacataaatttgagaggaataagaatagtttagtattgcaaactactcctcggccaccatggctcctgttgcaaacactgcagggattcatgaatattccagaaccacctgttgggatggaaagaaaaagaaaatggaaaatggaacttggcacctctggcaaagtgtaagaatgtattgtattcatcctatctgaaaccagtttaacagactgaatcttttgtgtgatctgttgtcaaagcccctcccggctttgcactccgtattcccaaccagaccagtctccactgtgggcagtggtacaactcacaaaccctcacagcgttcagacgcactcttttttgtttcaaggacaaggaaaagagatgtgaagtgtttcttggggcccagatggtgttattcataacagttgatggttagggttacaagattatatattcccatatagaatattcacacattatataagtattacttcatataatgtttatatatgtttaaatataaacatattacaaacatgtatatatttatgtaatataaatataacaaaatatagtataaaatatatattatatattccctatgtatatataataaagccacacctccaatttcaatccaaccactcagggttctttctagccttgcccctttctctgcttgtaaccatcatctctggtagtagtgagaaacatggctgccagtatcctcaatttatgtacctatttgctcaatataaccagtctcaaatccttctcccacctgccacctgcacccaactccccattccccaccctccagcctcactgaccaacccacccctctgcatgactccataacatcctttcactgccccatactcagctcccatgctgaccccttgccctgggaagggaaaaaaaattgggcacaggagctttttaaaaatggtatattataaagccaattaaatgtgcttcgtacttctagttgtttgcattatcagaaagcaagatttcctgctttctttgttgagaaaggtacttcttattgcttaggaaagttttgttttatttttttgagacagggtctcactatgttgcccaggctagtctccaactcctgggttcaagccatcctcctgcctcagcctccagagtagctgggaatataggtgtgagccactgcacctgacatgttgcctagaaatgctgaaatgggggtgaatgagaaatgctgtccctgcaggtaacttggtcaggttccagtatcccatactcccttatggaagaggagaaaagggaaagaattgtaggatcccaccatataacaagttttatgttccagaagaaagttctgcttttctggttctgtgtaatcatcacattggatggaagggaagctgaaggtctttccactgaattcatggaatattaaagttccagtccttgaacttgggtgtgaccttctgaaatgttcaagtttgtcagtggaaaacatgatcagatctcttatgctgcttttcctggctgctgacacacagtagattctcagtgttgtgtgttctcttttcctgaaagtttgtgcatgttactgagtttgccattgaattgtctttgtttgcatattgatttccacttcaaaaagtagtttaatactgtgaaagtactgttcctaagcaaattacagtacagatggtcagagtagaagtgtgtactcttgatacttccctcttccccctcaacagtggaatcttgctgggattttgtcagtgctgtttagatgggacgtttatccttatttgatcaatcccaaaaggcagcccctttgtggtagttttatactgtgaaaattagttttggaacattaagccaagaagtttgcaataaaatcaaatttgtttatgtattcatttgagacagggtcttgctgtgtcacccaggatgcagtgcagtggtatgatcatggcccactgcagccttgacctcctggtcccaagtgatcctcccgcctcagcctctggaatagtctggatggaccacaggcatgcaccaccatgcctggataatttgttatttttgtagacagagtcttactatgttgctcaggctggtcttgaactcctgggctcaagtgatcctcctgccttgacctcctacagtgctgggactacaggtgtgagccactgtgcctgatcccaacatacatttaataatctacattgcagggaattacattaggaaccatgtgtgggggaccagaagataagacttgcacgtagtcaatgcagtaatgagaagaccataagaaaagtctgtataagagagggcataggcatgactttgttctgtcctcttggccacatcctggctgtgtgaccttaagcaaattaacctaccaactacaaccattccttctgttgggaggagccaaatctgtgggagtggaaaaatcactgagaagaagccaaactctaggatgttgctgtagaaagggcctacacaccctgctgtagaaagggtcctagagtttggcttattttgtgtactggggatcactatgtctccttgcaaaccattgcactgggcgcggtggctcacacttctcacacttgtaatcccagcactttgggaggccaaggcaggcagatcacgaggtcaggagttcaagaccatcctgaccaacatagtgaaaccccgtctctactgaaaatacaaaaattagccaggcatagtggcgcacgtctgttaatcccagctactcaggaggttgaggcaggagaattgcttgaacacgggaggcggaggttgcagttagccaagatcacgccactgcactccagtctgggtggcagagctagactccatctattaaaaaaaaaaaaaaaaatctgtcttttcaaactctagtcttttatcaggtaaacattttctaagttttattcattttttttggaacaagtaagacagtttacttattcaaaatgtaaagggttacagtgaaaagttttgctcctgcccctttgcccagccaccaagttcacccaccagtggtggggaatgtggtatctttctagaactattcagtgtgtctggaagcaaaaggatatccttttacctttctgtatgcaaatagtaacgtaaatggacacaccattctgcacgtgcgcattttctcttttcagtgtattttggaaatcattcctatcattccataaagaacctcctcgttctggtccccatctctctggcacttgttttatgatttctcagtggttactgatagcagttcacagcctcattcccaagttatctccgtgtttggggtttaatttccctgggccaggatatttacattcatgagatggtttccttggactttagtttcctcccactaaggtttgagctacactttgcaaatgggcaaagaccatttttggatgtatatgcctgagggaagacagaaaaacaaagctgaaagagcatccagagggtttgccttcaccatcggaaaccactcagctccttttcagggctagcttttcagactgctttccgagatttctgcccactcctgtttggccatggccgtgtgccctattttcagtttctatatatgccctcatgttttcctgagcacatcaagaacgcctgcacggttacactggtttatttaggaaccgtcccctttcttcttcagtctgtcagttactcatttgaggtcagactcacaattctgcgaatgtcttagcctcttggaggagcatcgtgtgtgatgttggacaagctgcttagtgtctctcagctggtttcctcatccataagatggagttaatcgtgcccattacagagaattgtgacaagcaaatgaaatgacacatctgcagaactaagagcagaaactgaaatatagatatttttataaaatgtgatttttccctcaaataatcttctttaacagaatatcctacttaggaattatggcaaaacaaaaacaaacttaaaaaaatccacctgccttagactcttggtcatcttttaagattcttcaagttttgctttctttttttatttcctttaaaaggtttttttaaaattaaatctttattttatttattattttgttttttgagacagagtctaactccattgcccaggctggagtgcagtggcacaatcttggcttactgcaacctctgcctcccgggttcaagtgattctcatacctcagcctcctgagtagctgggattacaggtccatgccaccaagcccagctaatttttgtattttttactagagatgggttttcggcatgttgaccaggctggtctcgaactcctgacctcaaataatccgcccttccacctcccaaagtactaggattacaggcgtgagccaccgtacccagccctttattttattttatttttatgcaacagggtctcactctgttgcccaggctggagtgcagtggtgcaatcatggctcactgcagccttgaactcctgggctcaagcagccctcccaccccagcctcctgagtagctgggactacaggtgggcaccttcatgcccagctaaattttgtttgtagagatggggtgtcactatgttgcccagggtggtcttgaactcatgttcaatcaatgttcctgctgtagcctcccaaagtgctgggattacaggcatgagccaccaggcctagcttgagtcttaatttttttttggagtttccatacaccctctgcccccacacatgtacagcctctcccattatcaacatcccccaccagcgtggtacattgacatgacagatcattgtcacccaaagtccatagtttaagtttgggttcacttttggtggtgtacattctgtgggtttgaatgaatgtataatgccacgtatcggcaattgtaatatcacacagagtagtttcactgcccccaaaatcctctgtgctctgcccgttcatccctccctcatccctagtccctggaaaccactgatctttttactgtcccatagttttgcctttcctagaatgtcacatagttggaatcatacagtatgtcaccttttatattggcttctttcacttagtaatacacatttaagtttcctccatgtcttttcatggcttgatagttcatttctttttagcactgaataatattccattttctggatgtacaacagtttatttatccattctcctactgaaggacatcctggttgcttccaagtgttggcaattatgaataaagcttctataaatactcgtgaagctttgctttaagatgacatgtttttttctccccaagttaccatcacttatcaaccagttcttttttggtcaatattaaatttttccatttttggctccaactagtaaaaatagggccagattttgactaatagatgaaagaatattctggttagctgcagcaattcagagacaagcatgttgctccaggaagtaaggaactccatgtgcttgctagagaggtactcattctctacaagtggaggagctatggagtgacaggattggaagactttcatcaaagtcctttccaaccctgaaggggctgctattaaggtcaaagacctgttcttgggtacattttcttgtatcctcccatgtgggaagctctgttccaagcctttgggttacaagatagacagaagtccttgatgattcccaaacctgcatctcggatcccaacttgcccgttgtactccagaaacactcctcccactgtttgctgaaaatgtctggggaatattctgcatgtgtattcattcattccttcaatacatatttagtgtctactatgttccaggcatctttctgggtgctagggatgcagcagttaacgacaacaaaaaaagtccctgctctcatggatcttacatttcattctcaacatgtcttaaccaaacccatcatcctcgtttcattatagagttgtttaactgctttctctagcatctggatttgtcctaactgaagtggcatttctcagtcctccagatacattctagtgttatctttattaacttcctttctctcaacatgtaattgtcatctacagttgcatcttacacttcttatttatttatttatttattttttgagacgaaatctcgctcttgtctcccaggctagggtgcaattgcgcaatctcggctcactgcaacctccgcctccccggttcaagcaattctcctgcctcagcctactgagtagctgggatgacaggtgcccatcaccacgcctggctaattttttgtatttttagtagagacggggtttcgctatgttggccaggctggtcttgaactcctgacgttgtgatccgcctgtctcagcctcccaaagtgccgggattacaggtgtgagccaccgcacccagcccacttctttttatttcttttgcattcccctgacttcacccaacacagcatctcttacccaaagcacagtagcttcctgacttgagttgctgctggtggttaatgcttactctctcgtcctatgtgagtaggatcattttcggcccatcaattgaaaaagttggctaaaccagggaaacctaaaaaaattaaactatacttttaaacattttattttcacccaaaacatataactgcacatttgttcactcatctttagttatagagccaagacattgtcttacagtggtcttgttgattgaagtttttttaaacatctttccattcttatatctcctatgatttccagttttagtttttttaaacatgagaaagaacgaaaatacttaagaggaagattggatactgaatcctttcacatgtttgcaaatattcctctattataattgcttcagccatttttagtgactcatcttcattgagtcttttcaaaccattcagcatgtcttttgaggaagcgatatctctccctctttgtactcatatttcactagttaatgtacaaagttatggaaataaatttgcaagtacaactagcataaataggtttgggaacaaatatgcttgactcttactatgaagacaacccacatgatgggagcatgagtgcccaggtgtcccagagaggagactaccagccaaaagtgttcatcttgccaagggtgtcagtcagtgtgtcctgtaaacatggggtgcattggttattttggtgaattgattatctgtaaaatgttcagtagagagtgcataagagagcaacttctgtattaccagagtaatcttcctaagccacagctgtcatgagatcacttctctgctcgaaaaccttcaagcactcctcactggttgaggggccaagggcaacatcttgccttgtgattcattgtgatctatggctgtcttacctccctcccccgttggtgccttgactgtgaccttttcacagtcactctggtgaacaacgacggggcctgctgccggggccttgcttgtctaggctgtgcatgtccaagccaagcccctccctccctgctgcccccttctctcctcctgccactgcagaccttgatggatatgctgttcacctggaaaggacccgctcatagtagcacctccttcaaaaagcgtttcttgagctcctttcaacagggcatgctttttcctttaaaaacccttctgcagcaccccatgtgtatttgttaagtcactcccatatcctacctatactgcttctcctgcctaataactctctgttgccgtgagttgaacccagctcactggacctgctcgctgctcattcagcaagcaggcaactcctgagtatgggcgatgctgtcccctttatctcctcttcttcaaagactgtgtgtctttgaatgcgagctcaccaggctcccccaggcttcagtcatgctaactgattcagagcgaggacatggctcttttgaggttgtaaataatacatcaagtcttgaaggcttatctgcttgtctcccttgactttttcaagaagcagctttattgataataatttacataccataaaattcacccatttacagtgtgcaatccagtgaattttagtgaattgactgagttacaaccatcaccgcagatgagttttaagatattcctgtcactccagaaataccccatgctgctgtttccagtcaatatctgtttccaccaccagctccaggcaaccactaatctgttttttatccgtatagctcctcccttgactctccctgccacttcctcagaattggagtgttttctggactaatgtgtgtgctatttgcctaaggaacttttcttccgattcagttacgtaactttgtgatcttctctttcactcattctccccatgttcaagtttctcttggttttctttgttgtgtgaacctagtctctgttcaccgagttggcctttggcttattaagaaaactgagctttttcccctctttcagaatatggaaaacttgaatagtgtcatgtacaaatattgtagtgtcatgtacaaaccagatgctgaatgttatctaccgaatgaaggaatctgagccctgctaaggcatgggaaatcttgtcttctgttacattcagcatagtgcgtgtaaagtcactaaattattattttggttaataaatactttttattttttggtaaggaaaattacattgtttttattaagatgattcatgcttgatagcttaaagagtacaaacaaagtaataccttaaaaagaaaagtataatatgatccagtatttccacttctggttatatacccaaaataattgaaagcaggaacttgaaaagatatttgtgcgcccgtgttcttagcagcattgtttgcaataactaaaaggtggaagcaacccaagtgtccatcaacagatgcgtagatcaacaaaaatgtggtatatacatacaacagaatgtcaggccagccttaaaaagaaagaatttctgacacgtgctacagcatgtgctacctcaaagacattatgctgagtaaaaggattgtgtgatcattcctatgagggacctagagtcaccaaatccatagagacagaaagttgaatggtgattgccagcggctgcgggaggagggagtagagagttattcttttataggtaccaagttttggttgtgcaagatgaaaagagttctggaaatgggggtggtgatggttgtacaacaatgtgaatgtacttaacacctctggactgtacactaaaaatagttgagatgccagcctggctgacacagtgaaagcctatctttaccaaaaaaaaaaaaaccaacaaaaattagccaggcatggtggtgcgtgcctgtagtcacagctactcgggaggctaaggcaggagaatcacttgaacctgggaggtggaggtttcagtgagctgagatcgcgccactgtactctagccttggttgacagagtgagaccctgtctcaaaaaaaataataattgagatggtgagttttatgttacatatattttaccacaattaaaaaataaaaataataaagggaataacagaagaagaacagagaagaaagttaaagtactatctgaaacaccacgtcttagaaacaaccagtgtttgccacaggaatattctttataggaaaaaaaaaaaaaagcctgggcaacgtggcaaaaccccatctctatcaaaaatacaaaactttagccaaccgtggtggtacgtgcctgtggtcccagctactcaggaggctgaggcaggaggattgcttgagcccaggaagtcgaggctgtagtgagctgtgatggcactactgcacgccagcctgggtaacagagcaagatcaagtttcaaaaaaaaaaaaaaaagtccgagcgtggtggctcatgcctgtaatcccagcactttggcaggccgaggcgggcagatcacttgaggtcaggggtttgaaaccagcctggccaacatagtgaaaccctgtctctactaaaaatacaaaatttagctgggcatggtggcacgtgcctgtaatcccaggtacttgggaggctgaggcacgagaatggcttgaacctgggaggcggaggttgagccactgcactccagcctgtgcaacagaggtaagactctgtctcaaaaaaaaaacaaaaaaacaaccagtgtatggggatggttttctaagcatctctttcagcggtggtaccttcgtaacgacaaataccagtacaggttcagagtagggggaatccattcagagtccttgagaggaggcctgcagcagggatggggggctgatcacgcaaggcaggaaagttgtctgtacctgcagcagtgagtgcctgataggcctgtggggcggcttcagtgcccaccacagggcgtgggggagcccaggcaacagggagcctccttctgccattagtggagggaggggcctaggctgctgaggttgagcttcccaagggagttctgtagaggagagaataaagagcacactatgtgagttcactgagagtcctcgctttgagaaaaggtgacacactcctgggactcccagaaatactgcgggaactttgcagttgggacgataagtaaatgactagggccagaaaaatattatttaatactgtttttttcttttctttttttttttttttttttttttttttgaggcagggtctctgtctgtcaccgaggctggagtgcagtggtgcgatcacagctcactgctgccttgacctcctgggctcaagctcaagtgattctcctgcctcagactcccaagtagctgggactacaggtgcataccatcatgctcggctaatttttttactttttgtagagatgtggtctccctgtgttgcccaggctggtctcgaactactgagctcaagtgatcttcttgccttggcctcccaaagtgctgggattgcaggtgtgagccactgtgcccagccagtactgttaacatgaccccattggtacccctagacttgttggtctagggaaacatgagacacacaaaatacataggaaggtgttcagcctataattttcctttatatataagtgaacttcaaaatcttgaaggccaatgatgactttgatttttctgttttagcaatagggtcttgctatgttgcttagattagactggagcttctgggctcaggcaatcctcctgcctcagcctcccaaatagctggggctactggcatgcattactatgcctggctcaatgaagattttttatatttgtaccaaggtctcaaagaaggcagtgggcagataatagaggtgtcacacgctaggaggatggatcacctaatgaatcagtggctgagacaagtacagaggttttttttgtgtgtatagttttatagtgattgatatcagtcttctttcatttagattatagcaaggttattcatatttaagttaagccctattaaggctaaaaacattctaattcaagaaggatgttcaagattctctccttaaagatattacatattttatagtttgctgtttaaagaaactatttgttttctgtgaatcctgaaatgttgatttctctttgaagattctgtgtccagcttctactggagacaaagtggtttagtgtaggaagaacgagtgcttcagtggcaacaggcctgcattaaatttcagctccctacttttaatctatatgaccttgggcaagatagcgtaatctccctgaacctcggtctcttgcttgtaagtagagaaaaagaatggctactgggtcagaccacaccggattcgctggattgtaacactgaggaagtgtgccaagtgcgtaacagaatggaaagtaggtaactcagagggtgtttaattcaggggttcggcatgccaaaaagggtgcaggttctttccatctttttggtcgaccaccctgattgtgctggcttggccctctggccagctcccctcgtcatcacgagataactactagagttctggcaacctcaaaccgaggacagagtcccatggaagaagaaggtttcagtatctctttaagaataagagaactttccccagccttcctcccagcagacctcccttcaaatgtttttggtcagaactgggtctcatagcatccttgacctagtcactagcaaggaaaatggaatcaccaggattaacgtaggctgtgcatgaaggatctactactcagctaagaacaggccaccttctctcagggccagctccctggcaggcaggaaggaaggaaggaagatgtgggaaatggctgataggtagtccacagagactgccacacttgttttgtggtgttaatttaaggtctagtttattatttggatcaggaatgtttaaaaaattaatgggctttatcttttagaggtattgtaggtttatagaaaagttagtggaaagtatagaaagtttccatatataccccctcaccatcacctccagactcccaagttactaacttcttgcattaggatggtacatttcttggaattgatgagccagtgtaagtacattgttattaactaaagtccatagtttatgttagggttcacttttggtggtgtacattctatgggttttgacacgtatccaccattacagagtcatacagagtagtttccctgccctaaaaatcgcctgtgctccacccgttcatccttcctcctaagtgcctggcaaccactgatcttactgtctctacaggtttgccttttttgtcagatagctggaatgatgtagtgtagctgaaaagaagtggccttttcagaccggcttctttcacttagcagtatgcatttaaggttcctccatgtctttttgtgtcttgatcatttctttttagtgctgaataatattccattatatggatgtaccacagtttatcattcaactattgaaggatatttttgttgcttccaagttttggcaattatgaataaaactgctataaacattcatgtgcaggtttttgtgtagacctaagttttcagctcatttgggtagatatcaagaagctcaactgctggatcttatgataagaatatgtttagttttgtaagaaactgacgctgggcatggtggttcacgcctgtaatcctggaactttgggaggctgaggcgggtggaacatgaggtcaggagttcaagaccagcctggccaacatggcaaaaccctgtctctactaaaaatacaaaaaattagctgggcatggtggcgggtgcctgtaatcccagctacttgggaggctgaggcaggagaattgcttgaacccaggaggtggaagttgcagtgagctgagattgcaccactgcactccagcctgggcaataagagcaaaactctgtctcaaaaaacaaaacaaaacaaaactgacaaactgtctttcaaaatggttgtaccattttgcatttccaccagcaatgaatgagagtttctgttgttctacatccttgccagcatttggtgttgtcagtcttttggattttcaccattctaataggtgcataacagtatggatcgtgatttttttttttttttttttgagacggagtttcgctcttgtttcccaggctggagtgcttggctcaccgcaggctccgcctcctgggttcaagtgattctcctgcctcagcctcctgagtagctgggattacagatatgcaccaccatgcccggctaattttgtatttttagtaaagacagggtttctccatgttggtcaggctggtctcgatctcacaacctcaggtgatctgcctgccttggcctcccaaagtgctgagattaacaggtgtgagccaccatgcctggccatggatcatgatttaaaaaaaatactggcacaaggaaatttgaactctggctatttggtaaaaaattattgttaatattttttagttgagataatggaattgtgtgtgtgttttttaaagagttcttatctttagaaatccatgctgaaatatttaccaatgaaataggatgtcttggatttgcttcaaaataattgaagctagaggaagaagtgggtgatagatgaaaaaaattggctctgagttggaaactattgaaactgagttgagaggcatatggagggccattatattagttctctttagttttgtgtatgttgcggcttttcataaaaggtttttactaattaaagtttaatcatgtattatttaaaaatgatagagacagggtgcaatggctcatgctataatcccaacacttcaggaggccaagtagggaaaattgctggaggcctggagttcaaggccagtctgggcaacatagtgagatcccatatctataaaacatttaaaaaagttagctgggtgtgatgacatgaggctataatcccagctacttgggagggaggctgaggtgggaggatcatttgagcccaggagttcgagactgcagtgagctataattgggccactgtattcaagcctgggcaatagagcaagactctgtctcaaaataagaaaaaagatggacactttggtgtttagtaaaaattaggaactgtcttctggtcctacctttgcttaagtttagttcttaacagtattctgaggaataaatgaatatttgttgaatatatatgtattagagtttattattcaaggaatcttcctagaaactgaagatttttggtaatatgataaattttacttgaaattattatttttagagatagggtctcactctgtggcccaggctggagtgcagtagtgcaatcatagctcactgcaaccttgaactcctgggctcaagtggttctcccacctcagcctcccgagtaactgggactacaggtgcacactaccacacttggctgattttttattttttctagagatagggtcttgtgctgtttcccaggctgaattttactttaaattattttaacatttatgtatttttccaaataaatgtatttttaactcaaaagcaaaaagcagtacatgtgcactagaaaaaaaaaaaaaaggacaagcaataaaagaacttatataaaggacatcataatcttgcctactcagagagggccactctcaatcagtgccttgaggtataattgttgaaaccctttccatcttatccaggtatctgtgtctatatagtttttgtttatgtacaaaaatttagaattgtattcttttttttttgagacagagttttgctcttgttgcccaggctggagtgcagtggcgcgttctcggctcactgcagcctctgcctcccaggttcaagcgattctcctgcctcaggctcccgagtagccgagattacaggcacctgccactgcgcccagctattgttttgtatttttagtagagacggggtttcaccatgttggccaggctggtctcaaactcctgacctcaggcaatcccgcctgcctcagcctcccaaagtgctgggattacaggggtaggccaccacccctcgcccagcggattacattcttaacatatgtactgttttgcttttaacttagtatctgacacatagctttagagactgcataggaagccatcatatagctgtattatattttattaaacttggacatttgtgttgaacattgtaggtttttccagctttttgctattacaaacagaaaggaggcaacgtgcagttgttaagaacacaaactctggagttaaatggcatggtttctctgcagaaaagggtgaatgtagcaggtctgggactgctgtccttagaaaggctgcttccaaggttggcacttggctcgtgtcagggaacttggatttcggaagggttcctgccaccctaattggtaagagtggctcactgcataaactgtgcaaacactgtagtttatgctgaactcctgttttccttccaggagcctatgtgatcgcctggtaaaaaccctggatgctaagtctctagtgaatttccctggcagacatttcacacgtgttgtcacagctcattgctggaagaattaagcacaccctgaatgactacactggggggaaattcatggaagcttgcacctagtttcctctggacttggtcttgtagaccttttcccttttctttgtatccttttgctgtcatatatcatagctctgagtgcaactgtgtgctgagtcttgtgagtcctttcagagaatcaccaaaccttggggtggacttggggacacaggtttaaatcctggctctgctgctttctagcggagtaaacttaggcaagttactcaccctctcagtcattttctaatctttaatttgagttaaaaaaacagttttgttttataaatcgaaatatataatgtacttagaatagtgcctggcatgtaattatttctcaacaaatgttaagaattatcttgcaagctagatgtttgtgtatatttgtaactatttcttttcttctttttttttctgagatggagtctcactctgtctcccaggctggagtgcagaggtgcgatctcggctcactgcaagctccgcctcccgggttcacaccattatcctgcctcagcctcccgagtagctgggactacaggcgcccgccaccacgcccggctaatttttttgtattttttttttagtatagtagagacagggtttcaccgttttagtccggatggtctcgatctcctgacctggtgatctgcccgcctcagcctcctaaagtgctgggattacaggcgtgagccactgtgcccggccttttttctttttttttttgggacggagtctcagctcatcacaacctttgcctcacaggttcaagtgattttttctgcctcagcctcccaagtagctgggatcatccctgcactttgggaggccgaggcgggcagatcacctgaggtcgggagttcgagactagcctgaccaacatggagaaatcccgtctctactaaaaatactaaattagccaggtgtggtggtgcatgcctgtaatcccagctactcgggaggctgaggcaggagaatcgcttgaactcgggaggcggaggttgcagtgagccgagatcgcaccactgcactccaacctgggcaacgagtgaaactctgtctcaaaaaaaaaaaaaagtgctgggattacaggtttgagccaccgtgactggcctgtaactatttctttcaaataaatttctgtaagaataactgctgagcttaaggatatgtactttttttaatgtgttctggtcatagtagtaaaatatatttattaagacagatatttggtatagaaaaaaagtctttcctaattctatatttcagatatagttatttctaataatttgctatatacatgtcaaaatttatttctacacatattaatatggacagtagaatatagaaatttttaataaaaatgggaccacatatatattattttattgtttatgcctgtatataagggatctttatattcagtgaagttccataaaaacctttttgtcttccttaaaacgcttagattataggtgaagtaaaaaatatgtaattataatgtccaagttgtcaacttagttatacctttacatttgaaattacacattatagaaatacagtaatttagaaattacagacagtccctgacttatgatggtttgacttaggattttttgactttgtgatggtacaaaagctatactgtacttcaaattttgaattttgatcttttaccaggctagtgatatgtggagctacacttttttgtgatgctgggcagtggttgtgagccgcagctcctagtcagccctgcaatcatgggggtaaaccttcaacagtactgcgttgtcagcatttttttgaatattgtttgccagcatttttgcatccatcctgtctacaaagcccatctcgacttagaatattttcagtttacaatgggttattgggacgtaacccatcataagttgaggagtgtctgtacactgttgctttttttatagtcatcacaggcgtctttgacatgtcaccctgtcaccatgatcatcagagccacttttaaggtttacatcagatacacagcacatcagcttcacttccgcgtgttgcttgattccactggactctttgattccacaggaaattttatcctgttcatataacattcaggcagttggtttttcatttgcccaggatgtgtgactgccacaacctgactgatccctgaactgctttttaaaattatccatggctgggcatggtggctcatgcctgtaatcccagcactttgggaggccaactcaggtggatcacctgaggtcaggagttcgagaccagcctgaccaacatggtgaaaccctgtctctacttaaaatagaaaaattagctgggcatggtggcaggcgcctgtaatcccagctacttgggaggctgaggcaggagaatcgcttgaacccgggaggctcttgtctttgacatgctagttctgtgggagaaaccccagctgggcctggtggctcatgcctgtaatcccagctactcgggaggcagagggaggtggatcacttgaggtcaggagtttgagaccagcctgaccaacatggtgaaaccccatctctacaaaaataaaaaaattagccaggcatggtagcatgcacctgtaatcccagctacttgggaggctgaggcacgaaaatcacttaaacccaggaggcggagattgcagtgagctgagatcacgctattgcactccagcctgggcaacagagcaaaactgtctcaaaaaataaaataaaataaaataatacaagcattgacaggtacagaagtaccatgagggagacagcattgaattctgtctgagatgtgcaggcagaccaaaggggggtgataacagagcaagaatttaaaagatgatatatattactctgcttcagctgccataaccaattgcacagactggatggcttaaacagcagaaatttatttctcggagtgttggaggctggaagcctgagttcagagtgccagcatggctgggttctggtgaggagtcttcttggcttatacatgccaccatctcactgtgacctcacataacagaaagagagagagagaaagatctcttcctcttctttttttatttttatttgttttattttgttttgttttttgagatggagtcttgctctgttgccaggctggagtacaatggtgcgatctcggctcactgcaacctctgcctcccgggttcaagcgattctcctgcctcagctgagaaggtgggactagaggcacgtgccaccacgcctagctaatttttgtatttttggtagagatggggtttcaccatgttggccagatggtcttgatctcttgacctcgtgatctgcctgcctcagcctcccaaagtgctgggattacaggcgtgagcctccgccagcctcttcctcttcttataaggccacctatcctgctagattagggccccccacccttatgacctcatttaaccttaattacctcctaaaggccctgtctccaaatactatcacattgtggggggtagggcttcaacatgaatttaggaaggacacaactcagttcacagcagatgaataagcatttgccaggcagctcagttatggacgaggtgttgaaaccgacggaatatagcagatatgaaagcatagaggcctgaaacaatagggtgtgttcagggagctacagctggctcaacattgctgtaatataagttgggagggagaacttctgaaagctgaggctagaacaataggggtggaggtggagcacatgattatgaaggaccttggtatactaagcttagaaggacttcatcttaagggtagaggggagccacaggaacttctaggcagaggcatggcgcagtcagatttgcatttttgataattcaggtggaggagcaatttaagtagcagcgaaagtggaagtagtaagttagttgggaagctaatgcagtagcccttgtgaagcaaagatgcagcaaagacaagagaggcaaagtctggaaaatgttaaggtgatgaaatgtgcaggacttgactagatattttaaatgtgggaggtgagagagccataggagtccaggttgggttggggtcttacttgtccagtttccataaagagacatgttaattacttgacattttacagaattagtatattgactcattgatttccaaaactctttgaataagtatgtaactgttctgtagattgaagttgtgtcactcttaccatgatcacaaactcaggctctgcctatcattttggaactatttggggaagtcgaccatcttttctgggctagttacctttttaaaaggggagggagttgcacttggtgtcatatgcatttctgctctaacattgtttcctgctatttattttccttagtatatttgcttgtacatgctcagtattgtgctgtgttttatagattacagaaataaaactgtgactcttgtctttgacacgctagttttgtggcagaaaccaactcatggtactatactaccactaaaaagaagtaatgtgtatttaagggctaatttgtgtctgctgcctgcagcctatacattggttcattcatttgttttcattcatttgttccgagtctctgtgtttataaagtttacactctagtggaggaacaataattagtaaacatgtagtatatggaatggtgatcagtgtcacagaggccagcaaagtaggagagggtgtgtgctgagggtctggcttactatttaatgtggtgcgatgagagaagcccccttagtagggtgacatttgagcaaaggcccagggagtgagagagggtgagacataaggtctatgcagtgtaggtgtcgggaggaagaatgttgcaggcagagggaacaccaagtgcaaaggccctgagatgggaacatgccccgcttatttgaggaacagtgaggaggccggtgtagcaacagcaatgtgagaaggggaaggtgagttcactgatgggggaagaggaggattattcagggccttggaggccattgtaagggctttgactttccctccaagtgagacagaaagacactggagcgttgcaagtgggggtgtgacatgatttgacctaggctttagaagcatcactctcactgtatgtgcagaatggactataaagaggcaagggcaggagaagtgagactggttaggaggcagttgcagtaatcctggcaggagatgacagcggcttggatcgggggtagcagtggaggaggtgagaagtgctgagatgtagggctatttatgatacacatactgacaggcgttgttgagggacgagatgtggcatgtgaaaggagtcgaggtttctggcctgagtcactggaagaacggaactgccacttatggagatggagaggactattaaaaaacctaagtggaggtgtcaagagaaggtgtcaagaaggtagttggacaaatgagtctggagttagaagagggaaccagcctggagatatgtagatggtatttgaaagccacaagttggtaaatcaaagaccaagagagtatataggaaagaggtctgttggctgagctttagtgcccagggtgggtcaagatgaggaggaaccaacaaaggggactgggaagaggcttctaggggagtgagcagaaaactaggagagggtagcatcctggaaccaagtgaacacactgtttggaggcgttaggagtaatcagtggtgtcctacgatgttgatgcgtgacacctgagaatggaccgtagtgttcaagtgatgcacgagatagaaccagtcataccactaatggtttttttagtcctaaatatttttactgcaagatttcgttgttctaagtgttttcactgtcagatgaaggatgaaagtcgttcagggtaatttccattttagtaatttccgacagcggcagaacagtttctacttacgattggtatgcatttttattattagccatagtattcattttgggtgagtacgtctttgttagcgttatttttcttcaccacctcctcgagttgttcatccattcattcattcacccaaagaaatgcttattaagcgcctgtcctgcgctagtcctaggtttctcttgtcctgataggtctagcttcacacgagcaggattttgcctttccggcggcactaggcttccgcctcaccgcagtggggtttttccagcctaccttgtgcagctgcggttctcagcatccgcgggcggaggcctgcagccggtcagccggtgcgtcccgcccacggcgcggggccttctggcagccaagaaggaaatacagatgaggtgggcggacagtatgcagatgacgggggcgggccgcgcctggcgggcggtgtgcagttgaggtggtccggcaggatgcagatgaagggggcgggccgcgagggcgggcttgatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaa

SEQ ID NO: 494 - DNA, 81090 bp, Homo sapiens
cggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaa

SEQ ID NO: 495 - DNA, 158666 bp, Homo sapiens
cggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagtactctgcacctttttattttatcatatcataggcatccttccaggtcaatacatagaaatctatcttattttaagagcaacatgaccttccataggaaggatatgtcctggaatattaaaatattgtcttactaatgcacaacaaggttataattttttttttatgagtaatgctataatagcagtccttattcatatagtcctatgtagttgtggttttatttttatagaatgggtttttcaaaatactattgctgctctaaagtatatgcacatttttattttaatagatgtctccaattactcacctgagtgctgtgacatttcactcttgaacatgcccatctgtatacatcctgagcagtagtggagagccttgatcatatttttgccaataggataatcaaaaaatactatcttattagcactttaatttgcatttcgctgagttttttttttttttttttttttttttttttttaaagacagggcctcactctgtcacctaggctggagtgcagtggtacagtcatggctcactgcagcctcaacctcctggacttgagcagtcctcccaccccagcctcctgagtagctgggactacaggggcacaccaccatgtccagctaattttttttttttttttttttttttttttttttggtagacacgaggtctcactgtgttgcacagagagactggtatcgaactcctgggctcaagtgatcctcccaactcagcctcccaaagtgcagggattacagccatgagccaccatgcccagccctttctaagcacatctttgtatgtttactaaccactgcattttctcttctaagaattactagttttgcaacttttccctgctttttcactgagctgattgtttttttctcatcagcttataagtcagtattttattagggatacggttgtatcccctatattatgagcctttatcatatttttcatgtgatatggctttatctttatcatagaaaattttatatttttatgtaaactgttagtgttttcctttactcttttttttaagattccttctccccagtattatacaaatgtgctattaaatgtcttcatctacttgatgcacacacatatgcaggccatttgatccacctctctttatttaatctgatgtgaggtgtggttctttttctcccactgggtagcactgtttattaccagagtcatcctttgtccactgaattgaaatcccacctttacatggtttatgtcatccacattcagagagacctgccctagatgtgctcccatttctttctcttttgagttagctctgctttaaaatattcatagattattagattgcttatattacttttaactcatcctttcatttaaaatttttattttattgaattttaaggcagacagtatcagtgttgaactctgtttccagtcatgaatttacaaacgccagtcctctcttgagtgcagtttccccttcactttgtattatgaactgtttgcatcgagcagggcatgattttgcctgtcaccttctcttgctgaagcagatccaggtgtggcagggcctgacgtttgccccaggtccgtgtctgaattctgctcagatccactgcctttgcctgacagtgcttctgatcttcttctcatgacttaaacgtgttgggaggctcttgaaggtacatttgtattacatacttggaggtacagaagcccaggtagagtagagaagggtgagtgcctagttgggaaattcacctgtacccagtttcttctctgcctggtgagcctggaacgcagagccagctctctggatctctttgcgtgcccctcatccattttaggtgcacactgtggctcttcctatcctgccccttgtcactactgccctttatgcctagggtaaaccaaccttggccttctcggatgtaaattcttcttgttcctgatcctttgccaaaacgccgtgcatctctctgggcttctcatgctcctctccagccttggccctctagggtgggggacattagttggggttttcccatatctccattttctttggaagggaattgagggaaagcccttggtattgtattttcattcccccgaccgtgtactctctattagcagaaattcttcagaatctaagccacgtcaatgatactcgactacaggacttttactatttgattcttattgttgggatttgtagattatgatgctggtgttcaaattactttcttatcctgtttgtttttattgttatatatgcttttactgaaatttgaaagtgaaatttagaagatattgtttgacacctaagagacaaagtacttcataatttctgtcttcaaatagagtgaaaaacttctgttagatttgttttatgcaaaataagtatttagaaaaaattacattccaggcaagggcatagaatgagcaaaggcacagaggcagggcataaaagtaaaaaacttcaggtgaatagtccaaaactagatgggcagaggggagtcttgggagattaactgaaagacctggggttgggctttgttcaggtgttcagtaaagagaccggcaggcgtgagcatgtggttgacatgcgacccgccctcttcacaaatattaatctgccaattgtgaaggtagcagtggtgccatacaacactacccaaatggagttaacctttgaatactttaaaaatcatcatgtacaggagctcacctgttcctggatcagaatgaacaatgacataaagtgctgtttttaggaagtaaatgctgtagaccatgactgacatttgaaaactctgttctctaacataacaaggaaagcagcaaattagagaggttaaataaaagttttaaagggaaataattagagacatgtatgtatatgtgcttaaatgacaaggtgaggcatggaaggcagaccgacattcagtgaggagggccatgtgccttgctgtgctccatggagacactgtctgcttatggagtgtgcatcacctgctgtgtgtgacacagcatcaggcggtctggcctgcaactgttgttctctagtatctggcctgcaactgttgttctctagtatgggttgccgccttttaagagcagattattgtataaagataggaacactgaaataacttggtagtattttttaaatgtacttaaaatttaggaagaaataccatcagtattatttctagaaccttgtatatctctcacagaacatttatgcattatagaaaatttgagaaatgcgtggccagagctggatttgcaccccagtttcaccattcatgaatcatgtgaccatggtcaaattttcctctaaaataagggataataatatctagttttgttgaaaattaaattagataatgcttttaagacacatggtactgtgcttggcatatacagtggagttatacacattcatatttgttttgctgaaattatcgattattatcccagttttatatgctgggagcaggtagaatacttgcttcatttttgttgttttaagcatggcccctaaacactaagcacctatttaatgtgtgatgtaactgaagaaagagccaatcatgaaatgctggagggaatgcaagtatgtgagacttctggagagttggtgtgtttgtaaacagtcatgtttacaaaagcatgtacttttgagtgactcaaattattttcatggtttatttgactacatgtgtgattattactttgcaggttgattttagaacctaacatcagccttagaggcagtagcaagccttgaacaagtgtttctccagtagtggtaccttgcagtttttcttttatttaatgctaagacatacctggctgtatacttacatatttcttaatattcattatagaatacagagtttttattcttccttggaacagaggaaatgtaagacttcatttatggctgaggctgttactaattgatcccagccaattctaaaataggctggtgtaaggattttcagcctcatttatgatttaagtacatactaataagccaatagcattcttaataaccattttctttggttattcaattcaggctatgttttgtgaatccctctcacatacacagagagacacacagacacacacacacataccactgttacataacacagtgggtatttctcttctcaaattatacagggttttctcatactgactcttattgttctggccaagtagacttagtgtttgaaataccatctttggatacctgaagcctgaggtaattgattcttgtggccttgctttttaaatttatcatttgatattttgaattgcagataaatttagataactgaaaggaataacctcagcagaatgtaggcgtctccattttgttcttattaaattatcaaagaatgaaatgtaaaatgaattatttaaaatgattgtccttgggggcctttggtactgagtcatttaaatggactggtaagaaggtggccaggcgcagtggctcatgcctgtaatcctggcactttgggaggccaaggcaggcagattgtctgagctcaggaggttgagaccagcctgggcaacatggcgaaaccccatctctactaaaaaaaaaaaatacgaaagattagcaaagtgtgctggtgcttgcctgtagtcccagcaagctacgcaggaggctgaggcattagaatcgcttgaacctgggaggtagaggttgcagtgagccaagatcacaccactgcactccagcctgggcgacagagcgagactctgtctcagaacaaaaaaaaggtggcccattttgtttgttgatgaccttcatgagaatggctagcacagaccgaggaaattattttctgctcaaacctaacctgatttctttttctttctgcatttttgccacctgattttattgtatgggaaagtatgaaaaccagttcctctcaataaaattatttaaaaattattttaaaaacccaacctcctacaatttctgaagtgcctgataatttcttccaatgaagttttcagtttactgattttttttttcactcataagaagggactgtggagtgaagattgtaaggcagtgtggtttaactgttttaagttctgtttctcttaaatttattctattcatgttatttacagagcaacagaagaaagcttagagaattaaagacaaattcaactggagaagcttatgagtagtagctagattaatttgaaaatgatcagtaaataactattttatttactgatttattttaaacttccaccgaccttattgaaatatacttccagaaacattctgtttgaactattatcataaattagtcatcttgcaaaacagctgtggcaatatgatacaatgaagagagcagtgatttagcaatgagaaggttgggagttcttgtcttggctccttcacagggagatcacatgacatgccaaagtcccctatatgaggaagccatgcattgagaggattgaggattgggtcaatgatctatcatagaatgctttctatgagtctagaagcctcatgaagaacacaccaggaaacttgggtgagagcaggagcttcacctcatgcagaattgcagtgtgattttagagtgctgttaccattcttatgcttagaagtcagagtgtctgaatcaggattctgttgtgtataatggattgcactctcgttggcttaggcagaaaggtgttaaatggtttgcagaattgttgggaaggctgagcttccaggagcagctcccaaagtctccacacacaactggaccaccagggaacctgctccctccaccaggacaggagccttaacttcagaaagctgcccacccagttggaaagctgccaccacagttgccagcaccatagcatcttgtctctgctacagtctctgtctacatagtgaatgcccggtgccctgcctctcttcctctgattcaggtcccactccaggtcttgcccaagtctttctgattggtggaacttaaatcacacccaaaatcccagctgtaggagagctgtgagatttcatctttccaaactctgtgtactgcatgggggttggagcacatgtcggcagccggtccactgcattcaccattgacagtaggtgaaatatttatggtcaataacatttgcattttttcacaaaaaatgcacaatttgcagagtagccatacacactttttatttagagctaatatcaagtcactctacatataaaaataattatttctgaccatttcccaagaaaacagctcttctaaaaattgagagcaatgcctacattatttcctaaagatgcaaactggtagagaaaacaggatgttaaattcagaatttcccttccagcttcatttattttctccacatcagttctgttttcctctgtgtctttttctcccatggggatgtcctccatcttttcaatctgatttgctctttgccatgcagacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtatttaatcattttttctataagcaaagctccaaattcaaactttggcccgacatttgatatgtctactatctctactccaccctggccctgtgttgttacaaccacaagggcgctttccaggtcctaccacgtgcagccactgcatgcaggagcctggctgaggctccagggaggcactgatggagagcctggctcatgaataacacaaatgcagcctcttcctctctaccgcttccttccatccagttcctgccttgctacctttcttttctgcctctcatagccattaaattcaggtcactactatttgcctttttgtcatctcatgagaattatgagggtcagctggagacttcatctcctaggaaacgagacatcacatctctgcacctggccctcttggaggcacccctggccatccccatcttgcaacctgctagacgtttttctacctggtcttgtacgtgagcacctgtgctaatctgtcactcctgatctaggtgtgttcccagcttttcctggtgttgtctgatggtctcacaattcccctttagtcatgcttatcttcctatatgagaaagatgcgtagctatacttcatacatatactgtacacataaacatagcaaatagaagaaacagaatgtgcatctgtctacagtaacaatatctttcttccccagagtgcaacaaacatgccattgtattgggagactgtagtaaaagttaatcctaggatgtacctggttgtctctgctaaaattgtttgcacctaaattagattaagactagactctacatattcaaagacatgaaagcctttcatgtctgtgaagacaggaaatgaattaacaatttgtacaagaacttttctgttccttccttctctaggcatctcattatttatacagtttctttttgctcagctatccttcatctaagactgacctccactcagctaaatcttcccttcttgtttccccaaagcagctctagtccggagaagaaaaggataatagagtaaatattacactaaacacggatactccttaagccaccaaaaaaagtaacaagaaatcaggaacaagtatatgctattttgaagtggaacaacatataaatgttcccatgttttttcttggcaggtggagctggacagaatatttctgtccataagacccccagaagtcccctaagtgggataccagtgaggactgctccagcagctgctgtctctccaatgcaggtagatgagccccagaaataaccactgcttatggtttgctgtgtatccctctagatgtttttctttacacatattagtgtccgtgtgtgtatgtgtgtgtgtagagtatgtgttttgtaaattggattgcactatgcattattccaatacttatttcactttatcatcggaatgtaagcttcatgaggtcagatatttttgttcattttgcttgctgttttatctcttgtctgtaacactggttggcacatggtcacattatagtagaagttcaataaatattaaatgaatgaaggaatatgttttcaaattttaatatttgcagaaacgattctttttataaaagattacataatatgtggtgatttatttagccactgttctactgatagaagttaggtttttttggatttaacttattacaaaaaataatacagtgaagatactgatacaaatttttgaccacttaaggggctactttttaaataagggtatatcaagattcatttgtaagtatcagagatgactgtagttaagcagaaaggaatttaatacagggattttggtactgagggctggagaaaggtctaggctgcactgagcttccaggaaaggttcccagagcatctgaaagttggcccattaaaggagcttctgtttctgccagaatcgggaagtctttctctaagtgcttacccaggactgccactgctaccaagatctaggatcagcctggtgactacactgccacaggtgcagtccatgccagaaaagcacactctgtgcctgccccatactgaccagaaaacggtggaacagaccccagaacctctgctcccctgccacagaacagcgaatgccttcccagccatgtttaccaggagaagctgcagaagggaagccttacactcccttgcaccttccagatcctctgagaaggggcctgtttgacagaagctaggccacttgatgagccaagctttaaaggagtttgccaagtacaccctttagcttcccagtcccttatagttcaataagtcgccctacaaggagatgaggatggagttgagtgagcccgtcttgagatcttctacaaattgattcctagtgaaggaaaatggagtcctagaaaaggaaatgtatttgacctgttccagcatgtcgaaaaacttgatagacacattgcccttcagtttgccctcccgcttacagtactattttccaagaattttgacactgtctataatttttgaagatcaagtaagtgaacaataatatcttgttttactttatcagtaaggtggagcacttcttcgtatgattataggccatttatctcttgtgtgtcggtgtggaaacttacatactttgcctgcttttcttttgaagtgttagtctgtttatgttttgtaagaagtattgatatattgtgctttttaacattttttcatatgtaattgtattaccttttttatcttttaatgtcatattaatagttatcttttactgaagagaaattttacatgtttgtgttgtgttttaagattttgttttgtttcctgccttaaaatgtcttttctagctattagatgattaaaatattctccctaaatatcttaaggaagtcttttatttcttcagtcttaaaacccatagaaacatgggtttggatttagatattcttcccctatcttaactgccttctggaagcagaagtaaatactctctggaggacaattacaccatctagatccttaaattatagccacattttaaaaaatacaacgttatatagtaactttaaacaataccaggcatggccaggtgcagtggctcatgcctgtaatcctagcattttgggaggccgaagcaggcagatcacgaggtcaggagttcgagaccagggtggccgacatagtgaaaccccgtctctactaaaaatacaaaaatcaactgggcatggtggtgtgtgcctgttgtcccagccactcaggaggctgaggcaggagaatcacttgaactcaggaggcagaggttgtggtaagctgagatcgcgccactgcattccagcctgggcaacagagcaagactccatcttaaaataaaataaaataaaacaaaaaaccaggcatacaaatagataataccaaatgatgaaaagccaagagaaaaaatagacaatagaaacagacacggaagattcagatattgatattattagacatagaccctaaaacaactgagattaatgctgtcaacaaaataagtgacaaggtagagaatttcagcagaaaaccacaatgtataaaaaagaatctgttagagattttatgacttaaaaataaaatacctgaattaaagactcaataaagtttagctgtagcttaaacagtttaagagaggcttaaagaactgaagacaagtcagtataaatatctgaactgaagcacagagaaaaaggataggaaatagagaaaaggacataagaaacatatgggatggaataaaaaaatctcatgtgtaattggagtccccaaaaggggagaaaaagagcagaagtgatattggaagggataatgatcaagaatttccaaaactgataaaagatgtcaagcccagattcaagaaacaataagaaccccaagtgagataagtacaaagaaaaccacccagacacatgaggttaaaactgctggaaatgaaagagaaagcatcctaaaagcacccaaaagaaaaaagatacctcaatgtccaaggaggaagagcaaaactgacatctttcttctcaagaagaatgatggaagccctgaagacaatgcagtggcatctgcaaaatgctgaaagaaaacacctgctttcctttacctcatgaaaatatgcttcaaagtgctgtacctggtgaaaatacccttcaaaggtgaacacaaaagaaagatgctttgagtccaacaaaaccagatgttttttcctaggatacttgcagtgaaaagactatttaaaggagttctgcatggagtttgttcttttaaaagactattaaaattcaaaacatctgacaagaaaagctaatgcaaaattacctgtatcaggaatttgtaaatgggtacatcactaaagatttcataattattaaagcaatagtaagagaatattatatattactactttgtgctataaattagaaaatattgatgaaatggtcaaaatcttagaaaaatgtaacgtgctaaacttacataggagagagtagtagaaaatctcaatcacctataatttatatcttttccttaaaagaaatgccagggccttatggcttcaccatgaaacctcccaaacatttaaggaagaaataatgtcaatcttacgtaaattcagagactaggaaagaggtcagcatagctttgatccctaatagttgcaagaacattaatagacaagaaaattaaaaggtctttctcacgaacctctttgcaaaaatcctgaacaaaatcttggaaaaccttattcagagacacatgaaaaagatcatgtcatgttgggtttattccaggaatggaaggtggttaatattgaagccaaccagagtaattcaccacattaacaaaggtataaaaagaatatggttggccaggtacaatggcttatgcctgtaatcccagcactttgggaggccaaggtaggtggatcactggaggccaggagttcaagaccactctggtcaccatggcgaaaccccatctctactaaaaatacaaaaattagctgggcgtggtggtgcacgcctgtaacccccagctacttgggaggctgaggcacaagaatggcttaaatccaggaggcggaggttgcagtcacctgagatcattgccattccactcctgggcgacagagtaagactctatctcaaaaaaaaaaaaaaaaagcatatggtcatcttagtaggtggtggcaggaaaatgtagtcgataaagattaatatctttcttgatggaaattcttagaaaagtaggaatagaagggaaagtctttaatctgataaagggtctgtattatatatctacagcaaacatcatacttaatggtgaaatatcggatgctttcccacaggattgtgaatgggataggaatgccccatattgtcacttttgttcagccaacttcaaaagcaagatttaaaactacttttgaaaactgtataccacgaccattatatttttgtgggatgtggatacatggaattgtgtttaatatgctatgaagtagagcctctaagagaaaataatgttctggaaagcctcagaatggccctgcacaggcaaatgtaccaggttgttcattgcagcattgttcctaatatcaatatcaacatgaatatcaatagagaatcagtaaaataaattatggtaatgaaaatagctaagatctactgaatgcttactatctgctgggctgtgttttgattgttctaactggatttaactcatttaatcctcccataaccctttgaggtaagtacgtttagtatcgttgccattttataaataaagaaaataaggcacagaaaattaagtaacccagagtctcacaggtgggtggtgccatctgtccccagagccacttacttggcctcttgtggcacttctcagaggaagctgccaagatggtgggtgatggtgggtatagaatgacttctaagatacagtaagtgaaagaagcaaaatggtgtacaaaacaatataatgctatgataacagttgtgtttttagaaaaacagagggtgtttttcaaggtttttccttgaataatatcatgcttacttgcattctgaaatgcttttttaaatggcagtaaaaaaaatacaccatgaaatctactctattaacaaatttttaagtattgttaactagaagcacaatattgtatggcaggtctctagaaaaatttttttttaaatttttaattttatttcagattcagggtgtacatgtacagatttgttacatggatatattgtgggatgctgaggtttggggtatgattgatcccatcacccaagtagtgagcatagtacccaacaggttttcagtgcttgcctccccctcctctagcactccccagtgtctcttgttgccatctttctgtcctctagaactttgttatcttgcctgactgaaactctgtatccacggaacaattccccacttcccctccctgaggcctctgggagccaccactccactgtctgcttctgtgattttgactactttagattcctcacgtacatagagttatgccgctcttgtccttcagtgactggtgtatttgacttagcataatgtctccaaaactcatttatgttgtagcatgggacaggatttccttcttttttaaggctgaataatattccattgtatattctataccacattttcttcgtccattcatctggtggtggacactggggttgcttccacgtcttggctgttgtgaattatgctgcaatgagcaagagagtgcaagtatctctttgagatcctgttttcaattttcttggataaatacctagaagtggtgttgctggatcatttggtagtactatttctaattttttgaggaacctccatactgttctgcgtaatggctgcaccattgtacattcccactaacagtacacaggagtttcattttctctacctcctcaccaatacttgttctttttcagttttttttttttgatgatggtcttcctaataaatgtgaggtggcgtgtcactgtggttttggtttgcatttccctgatgattagtgatgttgagcatcttttcatatacctattaaccattaaaaatagaatacttatacacacatccttgaatatacatagaacattccaggaaagatattcacaaagccaattaataatgattgcccttggagagaagaactgggagatgggaaggaaaaggagactttctcttcattatttgcccttttcattgcttttggggatagtgtctattgcatgtattacctattcaaataaatgagttaattaaaaactcccctggttattccactgtgtttaagaactgttgcacacacacgcatgcacacacacacatctgtgtttgtgctattcttgatgttatgagctcaccgtgctggtgtccccctggtttttacagaggcattcgacttacagcagtgtgcggccagccagcagaggggtgactcaacgcttggaccttcctgaccttcccctctcaggtaaattatgtcaacataaagaacttttgacttatctttccgtgcagttaacttttcttcatttctctgcatgaaactgagcttagaaaaataatcagtggcatttcttgcaagtgatttcaaccccgaataatgtacatatcatgaatgttagatgcagcagtgcagctgacaaaaggaaaaagtgtctcctgccagctgcacttctcagtgcccttgtgctggggagacaggcccaattttttttttcttttccttttttcagagacatggtcttgctttgtttcccaggctggtctcaaactcctggtctcaagtgatcctcctgcctcggcctcccacagtgctgggattataggtgtgagccactgtgcctggcatattgttttttaactgaacctcaagagcatattttctaatctttaaaaagtaactaagggaaaaaatcttacctgattttgaatttgtctgctacttctgcaattcttaaaatttgcccctttaaaggtatttgtcttttggtgcagtcctcttcctgttgttacaccgtgtgtgtgtgtgtgtgtgtgtgtgtgtgtgtgtgtgtgtgtatttgttttttgttttaactccaatcctggttgtaaagtggaggttgcattcagcagtcccagcagtccccatccatcacatttgcgtggcgtcatatttcctgtgtcacaggctgatgtgaagcagccctcaagaagggacacgtgggcttgagtctcagtactgctgctcagcctggctttggccccatcaccccacttctctgtgctttagtctcctcatctctaaaacggaaataatccggtccacttcctaggattgtatcaaggattgagttagcacattaaagcgccttgaacatgctgggtgtgtggcaagcactgtggaagtgtttactgtgcacatctcacctgctgttctctgctgacccagttcgcctgcccagaactaaagggacaacagtgctcaagcctagtgggaagttaaggttgtccagaatacggggcttagaacctatgtatgtgtctatgtggtgactgttaggaaataaaaaaggcaaaaagaacactgaatggactgtttactggtccctgtagaagggatagaaagccaaaagtctgggtcacatggacagaaatccttttgtttctaagcataaaataaaatttctacagctgtacttcctttagatcttggtcaaacacaatcaggcttgttcttaaaatagttgtttctatgagggaactttcccctctgaatcttctttgctttttcatggaattaaataaggattttagagttgggtaaacactgacaattgagaatttgaagatgatctgagcccattcctcgagttttacatgggagagattcaagccctacagaaattgagtgacttataaaggctacagcgattttggatggctgtggggccaggaagtctcctgattctttctaccatgtgcctcttggtgctgaggctggtgattgctcgagtaatagctttctaaagtggtgaaagtttacgtgggactccaagtcatgatagtgacttcccagcagaaggaaatgaagaccaaaggccagtgtaaagtcaagagtgtaagaacaaacagagttcagtggaggtagagaaatgagagagtacgtgctccaggagaccaggcctgagtgtcccatactaggaggggagtggaggagaccagagcacagcaggaagcccacttggctcaccatctccgtgcttgctgtgtagcacaaaagagggaataatttgatgacacgcatagtgctaggtgtggggtttttgaaaaattgtggtaaaagacacataatataaaatttaccttatcaaccatttttaagtgaactaggtaagcctttggtagataatatttgttcttctctctgttccactagccttaaagttttctattgtgtagagacaccattctttctggttttctttgagagagagtcttgctgtcacacaggcaggagtgcagtggcattatcatagctcactacagcctcaaacatctggcctcaaatgatcctcctgcttcagccttcaagtggctgggactagaggtgcatgtcaccatgcctggctaattacaaaaattttgtggggggatagagacagggtctcactaagttgcccaggctggtcttgaactcctggcctcaagcaatcctcttgccttggcctcccaaagcgctgggattacagttatgagccatcatgcctggccaagaaaccattcttttttttttttgagatgcagtcttgctctgtcacccaggctggagtgcagtggcgtgagctcggctcactgcaatctctgcctcccaggttcacaccattctcctgcctcagcctcccgagtagctgggactacaggcgcctgccaccatgcccggctaattttttgtatttttagtagagatggggtttcaccgtgttagccaggatggtctcgatctcctgacctcgtaatccacccacctcggcctcccaaagtgctgggattacaggcatgagccactgcacccggccaaaaccattcttttagttgacacggtacatactgaacttgagaccacaatagcttattgctctgcagttaatatctcattgacagccctccctacttagcccccaccaggcacctgtctgcttggatgattatatttactgttattacagcaaaggattacagtgacaattacttgcttctagcaatccccaggaattgcttgtcaacactgaggtcattggaagctgcagaaaccaaagattaatgtgctgttcttgttgttcccttggatgtaaatactgtttttctctgctatttagagctgactagcctcactcccaactttactgcccctaattggtggcagtgagctgtggaaggattactttcttctgtgactattcacaggtcatgggcggcaactgtgggctcatcctggtccctggtctgctctgtagcttagaacaaggcacttagttctctgagctccagtttcctctataaatataaactagacagtctcgaaagatgtctcctgttccgcacttttatggtcctttgagaaatatagtctggctagacatggtggtgcactttcctgtagtcccagctacttgggaggctgagacagaggatcattaggaggtcaagtccaaatccagcctgggcaacacggcaagaccctgtctctagaagagaaaaagaaaaacaagtatcatctggaggattcagttcatttcattacctgttttttgactcagactaatatgacagcagaaaggagccttgaaagagtgattcctacttcttgtttagcaagccaggccctatggctagaatggccttttctcttgtcaagtagttcttcttggttcccagcttcttgtttattgctgcctgtggtctgatcatcacttgaggcattttcctgccactctctctcagatgtctgtcagttaaaacaaaagatactacctggggacagggctggcttcgttggcacttgcacaaggcccttagaaggacacatgcttggtgtaatgctctgatgacatcatcttgaaattcacagtgatttttgagcaggaggttgatttggtgctagatgctgtaaatgatgtagtggtcctgcctgtagaatccacatccctattgcatttttattacttcagaaactatatatatgtttgcacttgaggataaaatgagaactgtattgtatttgagaatgaagtatgatggcagtcaagagctgcttctttgggaatgagtgattatgtggttgttcccacagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcaggtatcgtgtttcaaacaataagaaatcagaaaaacatcgggctaatcaccttttattcttccttccgttttgtccccgtggccaatttacttctacaaatatttcctgcatgaaaatgactaagacactgtgcctgcccttggtgagtctaaaaggatgacagtggatagtagtagtgcgcaaaatggaattaagggctgtaaaaaacaatactgcataagcaaagtcttgagaggttgttagttggatcaagaagtctagagagaagtggtgtttctgccaagggctctaaaggtaccattacaagcacgctgtggaatagtgatcagggaatgtgggtggtgtcatgtgtctgaactagtctgtgggcttcctgagagccgggactctgctgtacatatgcataacaagctctctgtcagtatttgttgggtggatggataagtgactaggacattccatctggagggcatattgtaagtagtcttcattgctaaggaagaggtttgtgcattattttggtaaagcactggagtaccaccaagtttgtgggattttgtttcggattttgaggttgtacagtgagattggacctgcattttaaggaggattcatcagaaaacagtggtatataaggattgaagaggcattttgaaatcagtgtttaagaaggactgtcacagggatgtaaaggaatggttggcagagggagaggatggcaagaccagcagggtggtcactaagagcttgtctttgttcccacacctctgtcacctcctccctttccagtgcccctggtcgcccaggccacagcaaacctctttcagctgcttcctctccccttgtgacttccctgcttctctgtgttggttaattttctgatgcactgagcacatcctgctgcagaccttgcagaaatctcacatgactctgtcatctgcactcctcatcctggtcttctagatgccccacaacttagcaccaccccacccacctgccagaatggccctgttcctccctccacctgagcctgttttagtttctgcctttgtaatagaacatgaccatgtctgattgcaagtctttatgtataaggttctagcctgaatcgtttttcttttctcctttcatactccaaatactgcttctccttcaaggtcaaacctttcatgaagttgtacctaacacctggcacattgacatatcccttctctgactttggcgtcttacacttttttgggtgtttagtttttgtactgctttgtagtgtggaacactgttgcacagtacatgccattgtctccatttatgctataatttagttgacagtaaaagttcaacttacattttggtatctcttccagccccttgcattgtgcaacacacatagcatttcacttagtaaaacttacgagtgagtagatggattaatatacaaaattggctagtttaggagtaatagctttttaataaatcttataatcacaaatatgggtattatagaaggatttataaaagtctgaataaattcaggtcttgttacacctttgggtacagcatatatttggacccaaatagatgaagtcatgtgtttcagaagtttaatgtaaagccccagatactacatattgtcctgtttatgtgcaagagatttaaataatcaaaagaggttttaaggaccagaattagtgctgttctgaagttgccgttttctttatgccagaaatgcatacaaaaaggctatatgtatatgaatatgctattgatattttaccttttttaatgaaaagttaaattagtaaaattcttatttcaattttacacttacgttattgacataaacaatggcaagatatttggtgtttttaatatgcccttccaatgcacctttaaaatttattttattttattttttggagatggggtcttgctctgttgcccgggctgtagtgaagtggcacagtcatagtgcactacaaccctgaactcctggcctcaagcagtcctcccttctcagcctcctgagtagctgggattagagatgcacaccaccatgcccagctaatttttttattttttatttttttaaagatggggtctcgctatgttgcccaggctggtcttgaactcttgggctcaagagatcttcttcccttggctcgtaaagttctgggattatagatgtgggccactgcacccagccaatctaccttttacatgttatttaggtactggtttagtcttgaaacatgtagggtgtgttttgtttacgtatctttaattcaaatgatactgtacttaagtaaacaaatgaaagactagatggatgagcaacaaatggatttgaaaacaaaatgtaacaaaactctccccaaatttatgatagtcaggaagcacaatttaatttttattttatactgtgagatatcacaaaatagtaatgtgactaattcggctgtttctttagaatcttgctggataaactagacttttgcttttctaaagtaggtatttatttcttgtgtatttgagaattctaagtattagcatcttctccttaccatgtgctcttctttctaaccagtgtggaaagaaaagaccctctggcagccttggcccgggaatacggtggttccaagcgcaatgctctactgaaatggtgccagaagaagacacaaggttatgcggtaagggacaacatcagccaacttccagctgcccctgggcagtagtagtcctgtgccaatacatgttccttgtgtgcctgtgcttgatgggccaatatgcatgtaattgtcatctttctattctcctaggcagggctgccagggaatgtttgatatttgtgcactgcccaaaggcaccgtgacagaggcaaatgcaactgaaaaacggtctgcactccacccaccaaatgtatggctgcacgcagagctgcacctcccgagggaaggggacctttttctttggtcagagtgttactggccacaggttcttgggctgtcaatgcgatagaaattgtcatgaggccaaaagagttttctcaacaaggctttattggagcttatgcccttatccctcaggcatgagggaggaagcacgggagagggaggattctctggctgactccttgaaatgagctggtagggatttttttattaagcaaagtgcaggaattgatatcaacatagagaatgtgggctgggctgggtagatcatatgaggggtaggggatgtgggtcagtttatctgctggcgacggttgtcttgagtcatgggccacctagtgttctggttggtggcagcaaggctgtaaatcagttgtttagcattcttccctgagatgaggacatttgcaactttggttggatatgttggatttcctagggccagtttctggaattatttaagtaaaagaattaaacattcttttattcttttaaacattatgagagtgcggaaaaacagtatggctattttctttgcatgactgttaagcaggtatgtcagtgaagtagtggtgtgggttttgtgatcagtgggaatgcatgaaagaatgctatagtggggatgagctgaagccaagtcctgtccctgctgtctcagaagaagacacaagctccagtggctcacgcctgtaatcctagcactttgggaggccgaggtgggcagatcacgaggtcaggagatcgagaccatcctggctaacacagtgaaaccccatctctactaaaaatacaaaaaattagccgggcgtggtggcgggcgcctgtagtcacagctactcgggaggctgaggcaggagaatggtgtgaacccgggaggcgaagcttgcagtgagccaagattgcgccactgcactccaggctgggcgacagagcaagactccgtctcaaaaaaaaaaaaaaaaaaaaagcagacacaagctccccgagcagtgatgcctccacccaagaagacagcttttgctgaattaccctcctgaagaagagtgctttgcctaattcgcataaaggtcctatgtagttgggcctccaaaacttctccaaacattttgtttctattgttttgagaattgtttgcgtttagtttaagagtttttgttttctaggacagtatctgttttctgtgaatatcagaaaagggaagtaatacctgatgtaagtttaagtttttttcttgtgaaatacacaaagataaaatgcacaaaatataaatcataatttcttgaactgtgaggaagtgaaaagtcatgcagtcaccactcccatccagaagaggagcatcaccagctcccacagacccttcctatgactttcccatcatagccctcagtactccctaagataaccattgtcctcaattctccttccagatttttacaaaagtatgcatccgtaagtactatgttagtattgcttgcatttgaattttattacaaatggaataaaaaactatgtaatatttgcagctagctttttttacacggtattgagtcagtgagatttatcctcattgttgcatatagctgtaatttgttcattttcttcaccatttagtaacccattgtaggattataccattatttatccattcgattattgatggagagttgagtcatttctagtttggagctattatgaataacgctgttatgttcttgtgcgtatttcctgaaaaacatatgtgctcattcctgctggatacatgcttaagaatggaattcctgggccatagggtatgcatacaatctagtggatagtgccaaacagatgactgaagtaattgtataatttatgtctctccagcaatttatgagagatttatttctctgcattcacatcaacacttggtattgtcagtctttttactcaaggtcatgtgggtaatgtgtagtactgtctcactgtggttttggtttgcattttcctgttggctggggaggctgaacaccttttcatatgcaaatagataccctctttaaaattggcaattcctactgcattcttaacaatattttgctaaaatttcggaagattccagcaccgtaatactcccttcccaggctgaagcttttgagggaggtggggatggaaaatgaaagaagctagcaagaaaaacccagcctcagccaagatccatcccagatagtaaattagcagggctgggagtctctgtcatgtcagcagtcagatgtcttaaaaccagaatctacccagagtatgtgtatcctgtatctttgccattaccttcttttcactttatgttaaaaaagaaaaagaatcgcagcactttgagaggccgagggggcaggattgtttgcgcccaggagtttgaggctgcagtgagctgagatagcaccactgtagtgcagtgtgggtcagaaaaaagaaaagaaaaacctgtcatgctactgaccaataatagaggctcccaaagtataaactcgcctcagacccttgtttattcttcctgctaccctgtccactctgcctctgccctgtttcaaggatggaccatgccatgaaggaaggcctcttggttacagcctcccccagcccatcagccacgctgccgaggacacgggaaagaataagaagccataagaaccaatagctatgacttcttattctttcctgtgtccttggcagcgtgactgatgggctggggaggctgtaaccaaggggccttccttcatggcagttgaacaatgtgaacacttggacacaggaaggggaacatcacacacgggggcctgttgtggggtggggggaggggggaaggatagcattaggagatatacctaatgtaaatgatgagttaatgggtgcagcacaccaacatggcacatatatacatatgtaacaaacctgcacattgtgcagatgtaccatagaacttaaagtataataaaaatatattaaaagaaaataaataaatatcaagaaggagaaagaaaaaaaaagaataagaagtcagagggaggcagctgcctgcaggaggtttagcgtaaagaaaataggaatggtgatgggaaattgaagaaaacatttaaaaagagctgtcattcaagaatgactccactgatgccgcctgtgctgttccccacctgacagtaatggaccaaggcagctgccagagtgcatatgaaaagacaattcacgttttcagaaggagtggccttctatgatgtaaccttgttgtaatgcagggaagagacagacaataagatgtttccagtcaggatcacaagaacactatttcctgctggagtgatttgtgtgtgtgtgtgtgtgtgtgaacattttggattcgttttcaaaacattttacgtttgatgaaacccaaaactcattttgcctgtagtacttttcattcatcatgaaatctctgtaaaattagaaatatgaccatgtgtctgctttatttacccttcacaaaatatgtctagacctgtttgtctgagacacctcatagtcttgttctctcagaattaggaagccaaaaataactggtgaaaactttttgaaaaccgggaaccatgtgtacttgacttaaaataactttccttttatttcatcaaaatacagcgtgaaaggttatgttacatccctccatatatatatatttttatttcagctttagttatagattcagggggtgagtgggcaggtttgttacaagggtatattgcttgatgctgaggcttgagttatgggtcccgtcacccaggtagtaagcatagtactctgtaggtaggttttcaactcaggccttcttcccttcctcccttgtctagtagtccccagtatctattgttgccatccatgtggctttttttggagacggattttttttttttttttttttttttttttttttgagacagagtctcactctgtcacccagtctggggtgcagtggcacaatctcaggtcactgcaacttccacctcccaggttctagcaattctcctgccttagcctcccaagtagctgggactacaggtgcaccccaccacacctggctaatttttgtatttttagtagagacagggtttcgccatgttggctaggctggtctcgaactcctgacctcaggtgatccgcccaccttgacctcccaaagtgctgggattacaggttcacacctgtaatatacataaagggctactggatacatatacataaaaagggccactgcacctggccctttatatccatatgtactcaacgtttagctcccacttataagtgagatgtggtatttggttttctgttcctgcgttagtttgcttagaatagtggcctccagctgcatccatgtttttgttcttttatatggacatgatttttgttcttttttatggctgtgtatttccatggtgtatatttaccacattttctttatccaacccactgttggtgggtacttaggttgattttatgttttttctactgtgaacagtgctgcaatgaacatacgagtggtagaacgacttatttttctttgggtatatacctagtcatgggattgctgggtcaaatgttctatttttagtaccttgagaaatctccaaactgctttccacaggggctgaactaattttattcccaccagcagtgtataagcatttctttttctccatggcctcgctagcgtctgctattttttggctttttaataatagcctcctggctagtgttagatggtatctcattgtggttttgattcgtatttctttgaagattagggatgttgagcgtgttttcatgtttattgaatgtatatatgtcttcttttgagaggtgactgttcatttcctttgcctattttttaatggggttatttggtttttgcttgtggatttaagttcttatagattctggatattagatgcatagtttgtgaatatttcttcccattctatgggttgtctgttaactctgttgatagcttcttttgctgtgaaggaactctttagtttagttagattccacttgtcaattttttattttgctgcacttgcttttggggacttagccaaaaattctttgctaaggccaatgttgaaaaagttatttcctaggttttcttctaggatttttatagttcgaagtcttatatttaaatctgtaatccattttaagttaatttttatatgtagtgacaggtagaggtctagtttctatcttctgcgtatggtcagccagtcatcccagcagcatttgctgaatagggaattctcttcccattgcttgtttttgtcaaagatcagatgattataggtttgcagctctatttctggatactctaacttgtgtatgtgtctgtttttataccagtgccatgctgttttggttactgtagccttagaatataacatgaactcaggcaatgcgagtctccagctttgatcttcttacttaagattgctttggctattcagactctgttttggttccatatgaattttagaatagttttttctaattctttgaaaaatgacatttgtagtttgataggaataccattgaatctgtaaagtgctttgggcagtatagccatttgaatgatactgatttttccaatccatgagcatggaatgtttctccatttatttgtgtcatagctggtttctttcagcctccttccatatattgttcagctccaggtaatattgtaggtgctgggggccgggcgcggtgactcacgcctgtaatcccagcactttgggaggctgaggcgggtggatcacaaggtcgggagatcgacaccatcctggctaacatggtgaaaccccgtctctactaaaaaatacaaaaaattagccgggcgtggtggcacgcacctgtggtcccagctgctcgggaggctgaggtaggggaatggcgtgaacccgggaggcggagcttgcggtgagccgagatagcgccactgcactccagcctgggcgacagagcaagactccgtctcaaaaaatatatatatatattgtaggtcctggggattccacagtgaatgaaacaggcaacagtccctgctctcatggaacttaaatcctcatggggtctggcagttaactgaaataaaaggtaacatatgtacggtatttgaaggttgtattgccgtggagagaaataaagcagggaaggagggttgggaatgttgggtgaatggtacaatttatacatagtggtcagggagatgacatttgagcacttgctcccctctcttgaagggctttggtgtctgcatgaagctttatttcccaccaaggcctaggtgtggagggtcagagtaaggaggtcattactgtcgttactgtgccaatagaagctgaagtgacacacggtggtcgacccaggtcagcagcactgggaagtgagcatcgcagccagacccacctgccgagctccgggccaactgcctgacatctcgagtggcccaggattgagacccagtgaaaggatgtgagtttgccctcactacgaagtgaggcccagttcactaagctcaaaatggcgctcctaggaggcccttcctcacattctgctcaactcatacacactggtgtctttttggaataagtcactcctggaaaggccctctaaattactctcagtcctcaaatttcatactcctgatgtgtgttggctgttttccaagccaagggcaggcctgactcagataactcctacccctccctttctttcatctgaaagtctagtttaagctcctagttttctgttacgatggagagatttccatttgtaatttccagtaagaattctgaagggacagaaagtcgggagggtaggtgtgacaggaagaattctgaagataacccccatgactctccatggtagaatgtcctcctctttatatgacacagggagatggtctggatatgcccactaatcacaaacccctgtagaagccaagtgatgtctctggcttgtggcagaagttggggaaattcaaagcatgagaaggactctgattgttcttggtggtttgaagagggagggggcacgtgagaaggagccaagaagggccccctggctggcagccagcaggaaacagggactttctagcactaaagcattagtgctgaggtcctggccgtgcccagaaattgccatgtgggtgctctggagttttgaggttgacaactgcaagttgtgtgtagtgccaccgggtcctttgtctcctcctctgtcctgatgccctcagacctcagccaggccagggacgctcagtttgctttgccttctgctttccctcagctgggggatcttgggctggaagtcactctgatgaacatgtggaattcagctctaagtctctcctgagtcctctgttacctcccaggaggcatgatgaggcacagctacccttcacctccatgggtggcatgaagatacttgcaagtatcttttagacgaaaatatataccggtatttactgttacttgaattcctgtttggttcttgcatttcagatcaaaagaaagaagagtttagatagggatttacttgaaaatgtatctgtatctgttccacttttgaaattgtatggcaagaattcagatagcaggcgacacctacactatcattaagggacagatgacgtctttgaaccaggttttaacctgttagctcagacctatatcttcttctcttttggagaaaaaaaaatcagtctttgtgtgtccacactgaattttgctttgaatctggaaagaacacccatgttgcaggcaacttctgttgttctgtctctgagttcccacaaacaagcactaaaatctgcttagccaatagcaagcagcctctaaaatatcaggtcacttggggctctgtttcttatattcttttttgagacagatctcttgaaggctacacgcacaattcaaagaacataaagcctttgatttatttactgccatcagagtggtcctttccctgacttagatgatagagtctcaatagcagatgcgcggcactgtgggcttccactctattgaggccttttctacccactttctctgcttctgtaccgtttctgacacagtggtctgtgaagacattttcagtggcacaggtgttgtcctacaacctgtgacaacagtggagtttgtttgcaaaataaagatgcaaggctttcccatgttgtgggagacacagtcctctcctggtggccgtgtttctggttggttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggctcaccacaacctccgctcccgggttcaagattctcctgcctcagtctcccgagtagctgggattacaggcatgtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataaatctgtgaatagccgtggccatgactccatgctgcgtcctgtgggtccttcccctgatcattgaacacgggctttttattgagccttaaaaaggagtaaggcactgacacaggctgcagtatgaatgttccctgaagacgtgttgccaggtgaaagagctgggtgcaaaatctacatcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcaggaggactgctgagaccaggagttcaacaccagcctgggcaacatagcaaggccctgtctttaccaaaaaaaaaaaaaaaaaaaaaaaaaaaaaaaaaacattagccggctacgatggtgtacacctgtgattccagctattcaggaggctgaagacagagacttacttgagcccagaagttcaaggcctccgtgagctatgatcacaccactgcactccagcctgggcaacagagagagaccctgtctctggggaaaaaaaaaaaaagtgtgccatgatgatgaatatcacttaccatgcatttttatgcttatgctaaatagttgtgaaatagtgccaaatttttgtaaagtaagttcctagaagtgaatttgtttttgcaaaagggtgtgttacactttccattttaatatatattctcaaattgccttcattaaggttatttagtttacacttctctatacagtgtacaagattatacattcccaatactggatacacctactcttttgatctttttcagcctaagaggagaaaatggcatttcttttaatttttcattgcagatgaaggagaagcactttttatcaacttgttagttatttatatctttcttctgtgaattactactacagttgctttgcttgcttttctatttgtatgttcatcttttttcctcaaaatttgtgatagctctttttggttttcttttggtttttatttttatcaaagctctgcatgcccacaatcaggtatgcagagatcctgatgagcaaagcagtcagccggcctgagagctctgcttcctgctccccagagtcaagcattttcaagtcaccttgctgattttttttttgtcatttacctctacgttgctgactagcacgtttatcaactgctatttctagtttttcattttagatgttgtattttgatctcctactgtgaaagatgagggtttatttctttttcactcccaccccccccatgcttcctgtctttgcattctttcatggttgtacatatctggagttcacattaagatgctgtgagtgtcattcatagattagccatgtagtagtatacactgctgcagctttttcttttacacaacctgttacttgccttacacttaaaatcgtcttgtttttgtctgtttacttagttttgtatgtaaatgatactcattcaaccgcaactcttcatgagatatccccacacatcacaagggtcaggggttgcagctgtgttatcctgaggagatctctctggagcctctgacctcttccatcatggctgccctctatgcctggtgcacagagtccctgttagttctttgcctctctcttttttgatcttctgtatcctacatcctattcttttttttcccctttgtttttttttccctttgtttttttttcccttcagtatctccctgagaatgagttcatagatggtaaaattttatgacctcgcatctttgttttaccctgatgcttgatggtttctttaggtataagattttaggtcagaaattattttcattcataattttgtgggcatcgctccattgtcttctatttgccagtgttgcagcaagaaaagaatgattacagtcgtttgtgatttttttttcctctgcaaaagctcataggaggttctggttgtctccaggattctaaaatttcagggtgatgtgccttgctctatagcttaagttttgtgttttctatcatgctaggcactcactgcaccctttcaatatgtaattcatgactttattttctggaattatttcattggtaatttcttctactctgttttctttttctggaaatccccctggcctggccctctaattatcatattctttttttcccctatttctatctctttgcattacagttttgttttctgggaggcttccctaactttaatcttccaaattctattaaatgcttaattttgcatttttttttttgcttttgcatcatttcaattgttttttaattgtgaaatgtacataggataaaatttaccatcttaactatttttaaatgtacagttcagtatcgttgagtatgttctcattattgtgtaaccaatctctagaatgttttcattttgcaaaacttaaattctatacccattaaacactaatctgacattcccctcttcccccagcctctggcagcagccattctactttgtatcactatgaatttaaccactttaggtaccccatataaacggaatcatacagtatttgtccttttgtgtctggcatatttcacttagcatgatgtcctcaaggttcatccatgttatagcatgtgtcaaaatttccttcctttttaagactgaataaaattccgttgattatatttgctatcatatttttaacttctaggatttcttttttattccctgaaattttttatagcatcctgttcttgtttcacagatacaatgttacatatgaatttcactgaggattgtaggttgattttatcaccaaatctctctatgcagattgtttcctacagtccctttattccattggtatctttaggtctctatctttatgctggaggtttgactgctcatgtttaggtggaggctctgcaaagctgaccccctccctggcctgcgtatgaggcctgcgactatgttcctgtggcatatccatgacgaacttctggtgtcagtgtctttaggtggtccttcctcttgggcacatccattctccagagaaaggccttctagtctcctgctggaggacatcaacctggcaaccagaattgtgggacctaatcagaaaagaggcctgtgggccaggcacagtggctcacccctgtagtcccagcactttgggaggccgaggtgggtggattgcttgaggccaggagttcaagaccaggctggccaacatggtgaaacctcatctctactaaaaacattagtggggcatggtggtgcacgcctgtagtcccaactgcttgggaggctgaggcatgagagtctcttgaacctgggaggcggaggcgagatcgtgccactgcattccagcctgggtgacacagcgagactctgtcaaaaaaaaaaaaagaagaggcctgggggtggagagtgactacctcagccctcaccatgtaaattcacttaattcccttgttttcactgcatcactcatgcctccactgctcactgtcctctgggtgtgcacagaagagagaacgtttggagctttggctgctctataaacagatctccaacccattcttcctgtttttaaccaccttcattcccccacctgaagcacctcttgccaccaatttcctgtgtctttgagggattttgcaccataaatcaggttgggtctttgcccttcgccactgctggcctgggatttagtttgcttcggtctgttatgttagttatctcttgtccattgacttttcagctgccaatgttttgtctttttgctttctttcatgttccctttttccttgtctgttaatgcctttggaggaaaaattcctttctgtggttttctggggcttcacgagggggtgagattgtgaatgcatgcgtttcattgccatcagcctggaggcctcagagagctttattcctttctccttaaggatattaaccattatctgtcatagaggttccaagtaccctttacatatatactatattatatacaaatacacacacccttttgttccttctggagtgcatttgtgtttgttaggtcaagttttatttttcccccagatggatggctatttatttcagcatcacttatttcatcatctctcttgaactaactgataggcctaggtatgaatgggaactgagtggtgtctggacttgctgttcccttctgtgcctctgtgggtctggcctctgccacaggttgctgccgagcagagaaatgagagcaggacctgagtgcggcacagcgccctgggcctcagccagggtcctgtgagtgtcagtcagtgctgtggcatgcgttgttttgatgaatttaatgccctggcatttttcattatttgattatacttgttggttttctaggtaaactattacacataacaatagttttgtttcctttttttcttttttcttttttttttttttttttgagaggtagtctcaaaaaagtctcggctcactgcaatctccgcctcccaggttcaagtgattctcctgcctcagcctccctagtagctgggattacaagcacgtgccaccacacctggctaattttttgtgtttttagtagagacgaggtttcaccacattagccaggatggtcttgatctcctgaccttgtgatccacctgccttggcttcccaaagtgctaggattacacacatgagccactgtgcccagccttgtttcttctaatatttatacctcttgtactttttttggtttattgcattcatgaaagtccaggtcactgttgaataatgctattgatggtggatattcttgttttattttctgttcgtaataacagaaataagatttaataatattattaaataatttaataataatttaataatcacctaaatgagattcttgtattgttttgtgataaatactctatcaactaaaggaagcttgcatctgttttgagcttaccgggggatgttttaagtccagaaataggtaagaattatatcaaattcctttttagcttttaatgagctatccatatggtttcttctcttttgacccatttatgtaattaataacataaatacatttactagtaggggaacatttgtacatatctgggggcaaaattccaacttggtcatggtatactattcctgaaggaaactctacttgattgtggttattctttaatgtgaaatatacgattttttatactcagttattgatgagacatttggcttcttgttggttgctttggtataaatgaagttttgtctcaataaggcctgtttttgtttttgttatgatgttagtgagctctaaaaccctgtatcatctgtatatagtaaaaagtgcaataggtatttattttaccaccttctgtagtaggattaatgacagaattaattcttagccaaagagaatgttttatactctagttgcaaagttctgtccagtctgacaaatgaaaacctgaaaaccccaaaaatgttgttgggtagaagttgggaaacctttcatttaagcttcagacaatttttgtgaaaagtataagagtgaagacttaacatttttcctggaactgatgctcttttgttttgatgaaagtcctctgaaaggacttgttagttgcatagaggtaaggctaggcccctgcctattctcagggctcaaggcctgagcagccgaaggcccatcagtggtcccagttacctcagtgggagctcaagtgtcccctgtccccatgtggccacttgatctgctggattctgagtcaggtgtgttgaaatctcttactctgactgtggtttgtgtcaaaagctttgattgctgagagattatgttccagatattttgaaccatacgtaaaggtttcttgttctatcttcttggtggtttttaccttttacttcagttaatccttttgatctagaagcttacattttatataccaatattgctatttccatttatgttttctgtgcattttatgttttgcatttatgttatttgcatgatatatctttgtactttctttcctttcttctctttttttcccccagagttggagtcttgctctgttgcccaggctagagtgtagtggcacaatcatagctcactgcagcctccacctcctgggctcaagcaatcctcttttcttagcctcctaagtagctgggtctacaggtacatgacaccacacctggctaattctttaaaaaatttttttagagacagggtgttgctatgttgcccaggctgattttgaactcctgggctgaagagatcctcccacattagtctccccacttagctgggattacaagtgtggagccactttgcccagctcctttattttcagcctttcttagttggttgtttcagggttatgtcttataaatagtttggctttacatgtaatctgaaaattcctctaacagggcagcttagcctgttcacattttcttgtggctgtatgtgttttatcttcttcctctgtctcactttctatttttagtagacttctcttgctggcttccttcttactgattcccaggcacctagcagcgtggtaaggtgtgtgagttgaagaggtggaaaaacccaggcctgagactctgaggggtaaccacagtggaataatcataaagtttaaagctagagtctgtttttgttaaactggagcagaatcataaatcaaacacattttaaaaaatgcagagctacagagccggctgcattagtgagaaacagccccgtcggcccctttggggtcagaagtcagaattggaggcagggcctgggcccagttgctcttgccagggctgctttctggggtagaatggaggaagagccatgggcaagggccaagtccactggccactgtcaccaggggagcagcccgaagtcagggccgtacctgggaacaagaaggactccaaagacctggagcagatctggagcactgtgagttggaggagtcgggctcggatagcagcctgcaagggtgagggtgctgagaaagcaagatggacagagagggacagatgtggcccattcagggatccagaccagtgtctcatggcatctgatgtctagtcaccagcatgcatggggacatgcctggacacttgggctgatgcttctgcatgactgagcctcacggtagcagggtgcccctggacagaaacaaccacatgaccaagcagaactccttagcagccatttaaaaggataactggaaactctccaacctaattgggtaagatggcttaccaatttgctaagtagggcatatgcttaaagtactttttaaactttttttttaaaatgatgctgctaaatgaaagtatgtttaatttcacagggaggatctgtttttgccaaatgaagttcacttagctccttttattggtgctttggggaagagggggtgtggtctgtccctttagccttatagttcttgatctggtttttctttttttcttttttattgtaaaatacacataacatgaaatttatcattttaactattttaagtgtacagttcaggggcatgaagcacgttcacatggttgtgcaaccatcactgctttctatttccgaaatgttttcatcatcccaaactgagctctgtatgctttaaacacggggtaggggactccatattccccgccctcagcgcctaaccaccgttccgcttcgtctctgaatttacccattctagccaccttgtagacgtggacttacacagaatgtgccctttgatgaggggctgatttcactcagcacagcgtcctcaggcccacttatgttgtggcgtgtgtcagccacgctgcttctgcatccatctgtccaccttctcctctccatagtccccaccccatcctgggtcaggagttgtgatttttccttgtgtcttccagaaccaaagctgggagatcgcctgctaccatggcttgaaaacccttaacgactctgcagccagcagagttggacccatattcctggcctgtgtgaaagaccggctttttttaatgggactatttagctgtattatttgtcctcccttttctcagaggtatggaacatagctcccctccccaccctcaccacacctacctgaaaaacgggaagattagatccaccatgtccttaaggaaaagaagagagtgttttgattgccaacaatttgggctccaggcttctgtaagtcatcaaggtccatattggagaattagaagcaagagggtaacagaggcagaggataagagcagaggcttaggttgagggagagcagaggccagcgcccttggatgtggtggccgggggctgagaggtggaactgggaagactggaaactcagccaccctacaggctaagggcccacatcctccctcttctgacctgccaaattcctacaacatgcaggagaaagtgagggaactaataaggtgagcttattaatctggttaaaggttcttggctgggcacagtagctcacacctgtaatgtcaacactttggaaggttgatgcaggaagatcacttgagtatagaagtttgaggctgcagtgagctatgattgtgtcactgcattccagcctgggtgacagagtgagaccctgtctctctctctctctctctctttttttttttaaaggttcttaccatgagttagcctcgtcttctgacttcccagggtcatttgaaggaagcatctgcatcaaaactgccaatttacactttaaaattttttatataaatgttagatgttttgccagcttcaggaaggaaaaacaggattttcaaaataaaatgttataagaatgtgtcatcctcctggggactgagggtgatttaagtcccttggtcttctttcctcccatgggctgtttgtccccagctgagggcctccatgggtcaagtatgccagcagctgctgctgcagcataacactgcccaacaccaaagccatcatcttgtcaccattcagaaaaaggaggccttgatttttgctgctgttccttctccatcccccaggacagcatgtgagtctatttagataatcacagtcccaggtgaatctgcactgagcattttttccattctcttactcgtgaaatgttcatttgggaaaaagaagtaatttcatggcaagacacttatgatttcacaggctgaattcagtctttctgagggtagaaggttaacggagttgaaggttacttttctttctttttttttttttcttttttttttttttctgagatggagtttctcccttgttgcccaggctggagtgcaatggtgcgatctcagctcactgcaacctctgccccctgggttcaagcgattctcctgcctcagcctcccgagtagctgggattgcaggcatgcgccaccatgcccggctaattttgtatttttagtagagaaagggtttctccatgttggtcaggctgatcttgaactcccgacctcaggtgatccgcctgccttggcctcccaaagtgttgggattacaggtatgagccaccgcgcccagccttgaaggttacttttctagtataaactaaacttgatcttggaacaaaattccttataatcaatttttcagttattgcatattattttcttagtacaattctaattctgctgactacagagtcagaaagggtttaaaaaccatggtgacaggtggtctcccagccagagctgtggttttggaagacatgaggaagaccacaactcctgaactaggatgggggttgggatatggagaggagaaggtggacagatggatgcagaagcagagtggctgacacacgctgcaacacagatgggtctgaggatgcttcagtgagtgaaatcagcccatcaccaaagggcacgtgctgtgtggtggaggaacatagtcgcatgtgtgttgttgggaggtggagtttaaggtggaagaacctctttgagggcaatttggcagaatccatcaaaatggattccacctgtgtgcagagaggtgcatgggaggacaattatcgcagtactgtttgtgataacagaaaactggaaacaacctaaacgggctgctgtctccatccatgtgatggacctgcatgtgtcgtcagagaacaaagtagcgaatggtgatggaagtaaagctagcagtgacaaaatatttaccacgtgaccgacattgtctaagtgcatctaatcttgaccacaatctcatgagttaggcattttgtatccattttacaaatacaaaactaaggcagcaagaggctccatgactgctcagagtcacaccctagtaagggatagagctgggactgaactcctgctgttgggcccagcatccagtcccttggtctctacactgaaactgttcatccagatgtcgtgaaggacctagctctatatatcttggtaagggtgcagaacatgccaccatctgcataaaagggggaaatacacatgcatgtttgcataagtgcaagacagcactgtcctgtagaaccctctgtgatgatgggaatgttctatatctgtgctggccaatcctgtagccacaggtggctgctgagcacttaaaagattcctaatgtgactgagaaatggaattttgatattatttaattttaactaatttaaacagccacatggggctggtggctgtcgtatggggcaatgcaaggtagaatatagacagatggatgttaaagaaaagatcaccggattttgtggtttgcaatccctacttttaaaaaaccttctgcagaagcatcattggaagaacgggtttcataactgtttatttcagaaccactaatttaatctagccacttcatttgagagatgaggaaacttaaggcagaaaagttgagtcactttcctaaagtcatattcagctgcgttagtgtgaggaggaaggagcgggtcacagtttggtttggtttgttcctctttagagcatcggacattctcgtttgccaggggcttcattcaatctgatgtcagctcagttcttagcatggccggtcggttcctggaaatggcggctttgggtgaaaccatgtgctgtaagccatgggaactcaactctggcccatgtcaattagcctgcggtgaaactggttttgttatacagcgtgtcaccatttcacttaatgttacagtgtccaagaacctcccaacattaagtgaggacttactataaaagaaagaaagaaccagacttttgtctcctgggctcccagaactccatgaggaatcttgcagtggctcgccctttcctgaagccccagagttcatcctgcctcctgcacaccccaggctcaggctgtcctgcctgcctgcaccacagcatgggtgaaccatggtaggaccatgcttccctgcggtgtactcctcagcgcctcacacatggagggctttggaaatgtttgtgtggactctactcccagcctcgagggctgaaccgctagtgagttgtgcagatggctcatgaggagatttctccaacatttccttgagggagctgctggacacaggtaaacactcagcaaggagcagaatggggcttcagggggctgctagtccactgagcctgggtgactccaggaggagaggagccagcagagctatgcatgaccatgaccttttttagaagcagcaagcaaggaggaagagtggaattaatgaaaatgaggtagccaacttaacagaaaggcagaagaggaaagaaaattccagggaagtgtttccccagaggcctgagcatggtcctaggggtcagaagatggcagggaatcatctgggatccgaggtgagggcacagagaagacctgttctcaggacgccaaggaagaactgggaggcccctgctgagccgcggggcttcgcctgcgttcgggtgctgtgtgaggctagcactgccagtggaactgctgttgggctggaggaagtggacccagccagggggcaggaggtgttggccgcaggcccatgcttgcaaggcaaccagaccctgtgtcacaatgccaaagccagttaacctcggggaagaaacgccgtgggtggggacttctgagtgtttgtcaagtgaaaatggaggaagcaagaaagacagggccccagctgctcctgagatgtgtatcttctgtgattctgtctccagggagggactgtgcagcatctgcctgaacatctctgggacacagccgtcctctcgccataggaaggctcttgtccacagaggagtaaagggaagggcgctgcttcctgcaccagctcaccgtggccgctgtctccattttcgcagtctcaaaccctcggtgctttcagtgtggataaaagagtgggaggaacatttaaaaagtgaattattccaaattagtctctaaatttaatgcaattccgattaaaatcccaacagactttctttattcttgaacttaacaaagtaattaaaaattcacctggaagaataagcaactaagaagagccaaaaaagtttagagaaagagtgctgatgaaagtgggttgccctgcctgactggaaaggtgcaatgaagccacggcagaggagacccccttcacacgtcattctgcccaccgtagcgttgcagaagcaaagacacagtggaaacagccatgagcatggcccctgcagctcatgtttcagaatagtaatgacactgacttgaacgggttgaggaggtctgcatttttttaaatcttaaaagataagtagaagttgtcagatttgatttgggagataatgagccatataaaatctaaagtagaaaaataaataattggctgggtgcgtgcagtggctcacgcctgtaatcccagcactttcagaggctgaggcaggaggattgcttgacctcgggagttcaagaccagcctgggcaacatagtgagaccccatctctaagaaaagatgaaaaaaaaaattagccaggcatggtggcttccacctgtagtcccagctactctggaggctgaggtgggaggatcacttgagcacaggagattgaggctacagtgagccctgatcacactattgcactccaacctgggcagcagagccagaccctatcttagaaaaacaaacaaacaaaaaagattaaagcaataatatgaacaggagcagaaatggaaaggcattccaaggaatcccagagttattccatgagggacaaaaggtagctttccgctgccagagatgtgacttgccctttgcagcaaatataaaagaagtcacttcaggcattctgattgtctgtagctgtagagcaaaccaccccgaaacagtggattacaataacatcttcattaaccttatgaattaaatgtctttaatttttgccagtttgatgagtgaaaatgatattttaccgtttttattttctggtgagactgaacatcttttcatacatttcagactatttgtatttcctcttcagtacattacaggttcatttctctgccaatttttacttgagttgtttgtctttttctttgagacagagtcttgctctgtcaccctggctggagtgtagtggcacgatcttggctcacctcaacctctgcctcctgagctcaagcagtcctcccacctcagcctcccaagtagctgggactacagctgcatgccaccacatttggctaatttttgtatttttttggtagagatgaggtttcgccatgtttcccagactgttctcaaacccctggcctcgagcgatccacttgcctcaacctctcaaagtgctaggattataggcatgagctaccatgtctgtcctctttcttattgattacaggaatatattttgagtattagtcgtttgctatacatatattggttttaattttgtcatatagaaactttctttaagtcagatttcttaatcctttcctttatactttttgcattttgtgccttagatggctttctttccccaggattataagcctattcttctatatttttctttttataatgttataattttggtttttaagcttagccatctggaactcatctctaggaaacaagcgatgcgagactaatccctgggagaagggaaactcctgcagtgatggccagctcaccagctctctgcctgggaacaatatccacttcccagtgcagggagctggcctctgagcagagcacagcagccccactggctgaggaggcggtgatcagagaggggcagccaaagctgcacattttatggaatggggcatcagaaaggaggatgctgtgaagatagggggcccaggagtctatgtgcaggtctccacaagtcatggccaagggttgtgctgtccgtgtgcaggacgaggccactcgaggtttaccagatagtctgagatcagaacagaggtactaaaactggatgtgtgtgtacacttgtcccaggcaaggaccgaacactgaatgcacggcagggaaggagcacaggctgcatttgctgagatttcacatgaaatgttatgtgtgcatttgctttgtatcctctctgaccagaccttcaaagtaagtgtgatcctccctgggcttttattgcacatgctgagctccagtgaggaatgagctgcttttatcctctgtgatctgtaaactgttaaactttccaaaaactaaaaactcaatctgattccacagctgtgataataaagaccaattgggaaaaccccagagagattcagggagtgagactgtttagatcaccatgagcctgagacagctggttcctgcaagaatgaatgtacagcattttctaatcagtctcctgcctttttcccaagaagctttgcttttttctttttgacttttgcagttagtgtacacagagtcagttcattcacagacacctcatggaggcacctggaggtccttggtgaaggtaaagaagtactgggaatgcagccacggaatccagctgtgtcctcgattgaatttagcacagtacacaattcagtgtgtaccctgcagcttgtccccccagtgattgatgttttttaccaaatgttaataaccaaggcaaggcaagtaaccaggcaaccaaggcaagcgaaagcatcttctagaagcaaatgcgcaggctgtgtggttttgctttgccctgtcctgctgcgttattcatgagtgctgtctctacattcccccgtctgcaactttagtacaacctcaacactctgggaagatattcttggatatgcactaaaattagatttttaccttcccatgtgtaattcaatgtcttcatttttctcaaatgacttttgcttcattgaggtggacaaaattctgtatcttactttttttttttcctaaaccctcctagagacctataaccagttttggagatggttggactgttacccttttattaaacatctaagactttcatcaaaaagttccatattccactcagaaatattgctaaagtatttatatcctgggaaaagttaatttgtaattagtaactagcatttccctgggtaaaaataatcagcaagtttctttctgtttttgctccactttttcctccccaaaaatcttgtacataaattccaaatgttagtgttcagagtggacaccacactctagccccttaagacaatcagggtccttccctccttgtttccttcttccctccccctccctgtcctccctccttctctctccccttccctccctccctttctttcttccttccttcctttttttttttttgatagggtctcgctctaccacccaggttggagtgaagtgatttgatcatggctcactgcagccccagtctccccaggctcaagtgattctcctgcctcagccttcccagtagctgggattataggcatgcactatcatgcctggctaatttttacattttttgtagagacagggtcccgccatgttgcccaggctagtcttgagctcttgggcttaagcacctcctgcctcggcctcccaaagtgctgggatttgtgagccatcgcacatgacctcctttttaattgaggtataacatacacatgtgcatgggggatgctcacgaggtgacccaggtctagaaagcacagcattcagccccccagaatcctcttcatgttcccctggttaccagcttccactcaaggataacaatgatcctagtccgttttattcagggatgaatatcaaggaaaataccagaaggtaacagcctacagaatgcctgctgggctgcttttcattttcttctcatggttcttttgatgaacctctgagtctcagatgagtggtccttgggaaaagaccttaccatactaacatccctggggtggtctgtgtttcttcttagttttggctgcttctgtgagcattgaggactgtcgcgcagcagctcagccagatttcacccctctctactttaaggcctgtgccagctctagtcatcccctcgccaaaaatgagacttttcacctccatccaggggtaggtcctggagtgagttctcagcttgctccctggggtgcctaggacttgcccggccacccatgtcccacaaactgctgtttttctgcctggtgcccagtatattggccctgcccacacgagtaccttgctgccatggcttccttgacctctctggtcactgcagtgggactggatcttaacccacctacctgggacccacagaccttgcctagctcctggctgcccagggctggatgcttttccagtccaggaaaccagcccccaagagactggtgaatgatggcatgatcccatcgctgctgcctgcctcttccctccaacccccacgaactggcccccagggcccaggctgcaggagctcctggaaactgtgctagccccaagaaagtcctggctcctggaggactgatccccttgcactccttaggccatcggctgccgtcagcagcctcccctgcctcccctgggctctgctgatgagggtgcaacacactgcatagctcatagcctctgtacgtggtctgcaagggaacagtaatttaaatgacatggctttggccgggcgcgggtgctcacgcctgtaatcccagcactttgggaggccgaggcgggtggatcatgaggtcaggatatcgagaccatcctggctaacaaggtgaaaccccgtctctacgaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaatgacatggctttgaatgaactgagagctctgataaagcataactcaattcatctcttttctgcaagtcatcttccatccatgtggaaagtgtgaatgataccagttgtgccacattgatactgaccccctcgttcctgaaaatacaccttagagctcatgaaagcacaccccagttactggaaaggaagccacttttgttgtaagcacagcagcagagcagcctctgaggtgcacagggctctgcaggttgctgcttggccttatgtctgagtaaggcctaagtacacatagctttttttttttgttttatttctgagaaatttaattattttagttctttttttaaatcaacttttattttaaaatttcagggtacatgtgcaggatgtgcaggtttgttacataggtgtgccatggtggtttgctgcatagatcaacccatcacctaggtattaagctcaacatacattagtgattcttcctgatgctctccctcccccacccccaataggccttagtgtatgttgtttctctccatgtgtccatgtgttctcatttgttcaccttccacttataaatgagaacatactttgtttggttttctgtttctgtactagtttgctgaggaaaggggcttccagctccatccatgtccctgcaaaggacatgatcttgtttttttatggctgcatagtatggtgtatatgtaccacattttctttattcagtctatcactgatgggcatttgggttgattccttgactgtgctattgtgaatggtgctgcagtggacataacgtgtgcatgtatctttataatagaaggatttatattcatttgggtatataaccactaataggattgctgggtcaaatggtttttcttctagatctttgaggactacaaggaacttaaacaaatttagaagaaaaaaaaacaacatccccattaaaaagtgggcaaaggacatgaacagacacttctcaaaagaagacatttatgtagccaacaaatatatgaaaaaaacctcaacatcactgatcattagagaaatgtaaagcaaaatcacagtgagataccatgtcacaccagccagaatggcgattattaaaaagtcaagaaacaacagatgctggcgaggttgcagagaaaaatgaacacttttttttcttttttgagacggtatattagtccattatcatgctgttgataaagacatacctgagactgggaagaaaaagaggattaattggacttacagtttcacattgctggggaggcctcagaatcatggcaggaggtgaagggcacttctttttttttttttttttttttttttgtcccaagacggagtctcactctgttgcccaggctggagtgcagtggtgcgatctcggctaactgcaacctccgcccccccgggttcaagtgattctcctgcctcagcctcctgagtagctgggattacaggcgcctgccaccgtgcccggctaatttttgtatttttagtagagatgggatttcaccatcttggccaggctagtcttgaactcctgacctcgtgatccacccatctcagcctcccaaagtgctgggattataggcatgagccgccgtgcctggctgaaaggcacttcttacatggtggtggtggcaagagaaaaagaggacagaagcaaaagtggaaacccctgataaactcatgagatgttgtgagacttattcactatcacgagaatagcatgggaaagactggcccccatgattcagttacctccccctgggtccctcccacaacacttgagaattctgggaaatacaattcaagttgagatttgggtggggacacagccagaccatatcagatggagtcttgctctgatgtccaggctagagggcaggggcgccatctaggctcagtgcaacctctgcctcctgggttcaagtgattctcctgcctcagcctcccaagtagctggtactataggtgcacaccaccatgcctggctaattttttgtatttttagtagagatggggtttcaccatgttggccaggctggtctcaaactcctggcctcaagtgatccatccgcctaggcctcccaaaaagtgctgggattaacaagcgtgagctactgtgcctggccaaaaagggaacacttttatactgttggtgggaatgtaaattagttcagccgttgtggatgacagtgcacacggctttgaattgtcccccagctgcactggactgggagttgctggtgctcctgatgctcagctagaattagagataattttagatggcaactaggggactcggttggggttgttccactctgagatgaaagggaacgtctttatttaggagtataatgttcttggagcgagtgttatgtcacaaaccatagttgggtggcctctacctctgccaacgtcagcaataaaaagtctgaggcagggaaactttttagagagaagaagagtgtttcctgatcatgggcttgggcttgtctacctgactagatttggacttttataataattcttttttaagatggtacacattctcctttttcctgtgttgtttctctgtggtctcactgctgcagtgccaggatctgcattcaaatacggccgagcccccagagcaccaccagtgcagtctgtcctgaggcactggactctcagagctctcctgcgggtttcagtcattttgtttggtttttcaaccatggctttgatcttgccagactttagtctcaacctgtgacccatttatagttacagatcaagaactagtggtcactttggcaacatacataccaacatggaaatgatacagagaagactggcagggaccctacacaaggaaaacaaaaaaataacttttttttttttttttaaagagagtctcactctgtcacccaggctggtgtgatcatggctcactgccaccttgaatgccagggctccagtgagtctcccacctcagcttcccaagtagctgcaactacagacatgcaccaccacacttgtctgatttttatttttatgtattttatatttatttttttgagacagggtttcactctgttgccctggctggagtgtagtggcatgatctctgctcactgaaacctctgcctcctgagttcaagcaattctccctcttcagcctcctgaatagctgggattacaggcacacaccaccatgcctggctaatttttaaatttttttggtagacgtgaggtttcaccatgttgcccaggctggtctcgaactcctaacctcaagtgatctgcccaccttggcctcccaaagttctgggccaccactctgagcccaaaaactattcttgacagtgttcaatgaactagcatatgggcgccttcttggttgtgggagatggtggcattgttgagcttccggatccatctgacctctcaaatgcttctgaagattttgcagatgaagaaaaatgctgttttgtatcagaaatgatagaagatgtaagtgtgtatataatgttctcatgtttttggaaaagaaggatttagcaagtgttaaagtgaatttgggaagggagcgaggaagggtgagaaggagaacctggcccgtttggatgcacaagttccttggggcggtagcattcaccagtgcagagagcagtgccatccaccccagagtctgttcctggtgggcctggcctggcctcagaaaatggggttctagtttctttaactgacaagaaggaatcaaagtttcaccactcactcctctagaatctgccctctcccaccctcagcctttcctttcactcttgtcgaagacatgaattgagcaagctgcagggcctctttcagcagggtctgctggcagtgtccactgcaaatgggacatgtgcttcagaggcaaatggagctggcgttctggccctgactctggcgctagaaatatttctttttgttctggctttcttatctgtaaaatgggtataacactagtcaccgtgcatggctgtaaatgagaaaatgcacagtgacaggcttatcacaggcactcagcaaatgccactgcccttcccagcccaccattttttttttaaaagacggttttgctctgtcatgcaggcgggagtgcagtggcatgatcttggctcactgcaagctccgcatcctgggctcaaacgatcttcctgcttcagcctcccaagtagctggaactacaggcatgtgccaccacacccagctaatttttgtatttttagtagagatgggatttcaccatgttggcctgtccggtctcaaacccctgagctcaagtgatctgcctgcattggcctcccaaagttctggggttacagcgtgagctaccgcacccagccaagggactcatacttaaaggactttggtcttgctcattgagcatttggttttctatttaaaatgtggtctttctgttggaaacgatctagtatccgtcagcattgctcttgggaaagaacacttccaggcagggcaagcacttgccttgtgtacacagatgccttgagatcagcataatgtaaacgtcaaaacgggtttctggatctaaagcctggcttgctttcttccaggtcagcagtgcaagagatgggtttggagatagggtcgcagccagcctgtgcgtggcagaggaaggaagggggagctgagtactggcaggggccacagtgctctctgcccttcccaagaggaaagcagaaaccagaccctctgttagaggccctccttgttttcaccttcccagggtttgatgtccataacatctggtttgaatgattccagcgaactggatggggcaccccactgccccaccaccgcctgttttttcatctttttttttgggggggggacggagttaatctctgcaccccagctggagtgcagtggcgctatctcagctgactgcaacctccacctcccaggttcaagcaattctcctgcctcagcctcctgagtagcggggattacaggtaccagccaccacgcccagctaattttgtatttttagtagagttgaggtttcactacattggccaggctggtctcgaactcctgacgtcaggtgatccgctcacctcagcctctgtaacctacaaacctcttcagaaagtgtaaaatgaaagcatttccccatttctaaagcagtgtccaggtttcatcaggtagctgtcgaacccaaagagactttgaagccaagagtccacaggatcagcttcccagtggccccagaagttacaagatggggccctcccaacaaaaggcatcctcaggcttttacgtaatgctggtgtgcttagcgactgctgaaagttgactgtgcttgtgtcgtgaaagccaagatgaagagacgttattatggttgtgtgttgctttcagctagatactcctcgctggggaaatgtaactgcaaagcagactccaggacactgtcttcctgaaagccggtgcttttgggggacattctggggcccaccagggtcatcctggatgctgactggaactgagaagaggtttgctgggaagatagggacagattctttgtatctatgtcattcaggtaaaccctacatgtgacatgtgacaccatctcttttgacctcagtttcaaatgagatatttgaccaaccttattgctaagggtcaggctagcttgaaataaccctcaagaaatctagataaaaacctaaatgagattataggctttttttttttgcctaagattatttgcttccagaaccctaaggaaacttcacaggaaacatggtaccatattttagtacacatctccatcctatgcatgttctccagaacctcttcacacacactttgaggagagttccatcaaacctccttctcttattccatcttaatgtcatgcattatttctcttcatcctgcctctccttttcagttacaaattgattctgatagaaacaccctaaatgaccttcccagggcagtcagagagttaacttgttgtagggttgcatttggccatctgggcagagggaggaaacagtggtcagtgtccaccctgtgggagggaggcagcacccaccacagctttccaactttgctggcttcacatttcccaggacagggcaagaagaggaagagctcctcagtggctgtggggagagtgcaggaaggagccctagacttgcccatttcttcttgtcccaaaacccaacacagacctaaaactcagccaagcccaagctatgccccgcttctgcaatctcttgcaaggcccctgcttaaacaacctgagctcccagctttagtaggcttgggaacttgatgcttcatttgggacaaactttgtggatccagggaagaaaaccttgttggggtgagcaggtggccgacaggactgaggatctaagaggtggggatgcactggagtccccagctggcctaggggaccggtacaggagtcttcagaagccaccatctcgatgggcagggacttagaattgaattttttttgtttttgttttttttgagacagaatgtcacctaggctggagtgcagtggtgcaatctcagctcactgcaacctctgccttccaggttcaaggcatttgcctgcctcagcctcccaagtagctgggattacaggtgcccaccaccacacctggctcatttttgtatttttagtagagacggggtttaaccatgttggctaagctggtctcaaactcttgacctcaggtgatccacttgcctcggccttccaaagtgttgggaatagaggcgtgagccaccatgcccagctagagttggattttagtttccttatcactgtgtaccaagcagctgctgggggctgcacccatcccgatggaggagcttctttctccccatgcagcctcatgctccctgcttgtttggtgtgctgacggggctgctgaacaggacgggttttcttttccccctgagaagcctcctacattgtggggagaagagtgtggtaggaagagcaatccagagacagtcttgtaggtctttaagaccttctcatcttggtctgcttgttgcgaattggggttatacagagatggtgatggtggtagtgatgacggtggtggggatgatggtcatggttatgaaggtaatgacgacggtggtggggatgatggtcatggttatgaaggtactgatgatggtggtggggatgatggtcatggttatgaaggtactgatgatggtggtggtggtagtgattcctccttgaccaaataagtctgggaaatgctggcatgtacaaaactaatcaggtgggttaatttgagaataagatatctttgagcctttaatgactctcctgagggatggacagaaatcctctactgttttgagcactgaaggcttttcctcaatactattctgtgaatggatttgggcaacaccaggccattcctggtaccaaaacaaaatgtactctgagcaaatttgggaagtttattcttatgttgccttactgaaaaatccaaaggtagattcccatctattattattattattattattatactttaagttctggggtacatgtgcacaatgtgcaggtttgttacataagtatacatgtgccatgttggtgtcctgcacccattaactcatcatttacattaggtatatctcctaatgctatccctcccccctccccccaccccatgacaggccccggtgtgtgttgttccctaccctgtggccaagtgttctcattgtttagttcccacctatgagtgagaacatgcagtgtttggttttctgtccttgtgatagtttactcagtatgatggtttccagcttcatccatgtccctacaaaggacatgaactcatcctttttatggctgtatagtattcgatggtgtacatgtgccacattttcttaatccagtctatcattgatggacatttgggttggttccaggtctttgctatagtgattagtgccgcaataaacatatgtgtgcatgtgtctttatagcagcgtgatttataatcttttggatatatgcccagtaatgggatggctgggtcaaatggtatttctagttctagatccttgaggaatcaccacactgtcttccacaatggttgaactagtttacagtcccaccaacagtgtaaaagtgttcctatttctcaacatcttctccagcacctgttatttcctgactttttaatgatcaccattctaactggtgtgagatggtatctcattgaggttttgatttgcatttctctgatggccagtgatgatgagcattgtttcatgtgtctgttggcagcataaatgtcttcttttgagcagtttctgttcatatcctttgcccactttttgatggggttgtttgattttttcttgtaaatttgtttaagttctttgtaggttctggatattagccctttgccagatgggtagattataaaaattttctcccattctgtaggttgcctgttcactctgatggcagtttcttttgctgtgcagaaactctttagtttaattagatctcatttgtctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtctaaggtgtaaggaagggatccagtttcagctttctacatatggctagccagttttcccagcaccatttattaaatagggaatcctttccccgttgcttgtttttgtcaggtttgtcaaagatcagatggttgtagatgtgtggtattatttccgagggctctatgctgttccattggtctacatctctgttttggtaccagtaccatgctgttttggttgctgtagccttggagtatagtttgaagtcaggtagcgtgatgcctccagctttgtgctttttgcttaggattgtcttggcaatgcaggctcatttttggttccatatgaactttaaagtagttttttccaattctgtgaagaaagtcattggtagcttgatggggatggcattgaatctataaattaccttgggtagtatggccattttcatgatattgattcttcctatccatgagcatggaatgttcttccatttgtttgtgtcctcttttatttcgttgagcagttgtttgtagttctccttgaagaggtccttcacatcccttgtaagttggattcctaggtattttactctctttgtagcatttgtgaatgagagttcactcgtgaattcggctctctgtctgttattggtgtataggaatgcttgtgatttttgcacattgattttgtgtagattcccatcttatcacaatcttcctcatctgtgatactgcacagtttgcaatagttcttgtttattactacttttctctcctgcagaacattgacatcaccaatttcagcagcagctggagcgatggcctggccttctgtgctctgctccacacctacctgcctgcccacatcccctaccaggagctgaatagtcaggagaaagtaagtcatggccctgtcaccttggttatcctctaagaaatgcaggagtcctaattgataaaccccactgtgggagggggcttacaggcctgaagtagaagttgggatattgataccaggtacagataactcctgaatgtttgactgcaccgtggaatcccatcctcagcaaatcttcctcagtttcccttctcaggaatctcagcttcatggtttcaagaccttggccagcatttttcaaagcctattccaaagaaccagcaagcaccaacaaaaagaattccctgttcaaataagtcttggacactgtatattgcatcacattttcagagagcatggtgcctgttaacacattaaagacttcaagaagtcctacattaagaaatctatgtgactgtttaacacagcatagatcagatccacttaacctctttacttatatttgtttgttttactacaatcacacaacaagggttggcaaattttccctgttaagggccacgtaatagactcagtgggtcaggtggtccagtcacaactgttcaactctaccatcgggctaaagaggccattgatcactttgtaaatgaatgtgcatggctgtgtcccaacaaacctttatttacaaaaacaggctatgagccagatttgggacagcagtttgccaacccctgacctagaacctcctacaaaatgtcccacagagcatactttggaaaatactgtgctgggtcccgctgttggtcactcaagaatttcttgtcaagcatcgggcactatcataagaaaacaggcaacaatagagacgttctatgccctcatgagctagacagataataagcaagcgagtagacttataacaagtaaaattataaattagcaaggataagtggtctaagagcccagagagaaactcagtgctgtgagacagagtgacggggatcacatttagaccagggagactgcagcggtgatgtcagaactggtgttggggctgggcatagtggctcccgcctgtaatcccagtactttgggaggccgaagcgggtggatcacttgagttcaggagttcaagaccagcctgcccaacatggtgaaactccatctctactaaaaatacaaaaattagctgggcatggtggtgcacacctgtaatcccagctacttgggaggctgaggcaggagaattgcttgaacctgggaggcagatcgcaccactgcacttcagcctgggcaacagagcaagactcctcaaaaaaaaaaagaaaaacaaactggcattggaaggtagaggaggcagcagtgcagagccagggctatggagcagcagcagctggggaacaccttggtgttgtccaggccgtggaagaaggctggttggctggatgcagttagtggggccagagaggctgtgctgatccagggaagtggagggggcagacccccatagctgggctgatctggggagtctggggcgggagaggcgacagagcttccccacagctctggtttggcctcacccactaaccatgagggtggtagcaacgcagacggaaagacatagaaggatttgaaatatgtctcagacagaatcaactggatttagtgacagattggttgtaggggaggaggagaggaaggagtcaaagatgacgccctggtgtctagtttgaaagggccattttctgagatggggagggcatagatatgtttaaaagctctgtttcgattatcccacatcaggatttaaataaagtacaaagaaggatcatagcaatgacaaaaactgagcaaagtaatttaatttttaaggtgttagaattctccaaaaaagcagaaccaaaagagagagagagagagagagagagagagtgtgtgtgtgtgtgtgtgtgtgtatgtagagagagagagagagagaggtgggggctggggagagagatttattctaaggaactagctcgagattatagaagctagcaagtccagcatctgcagggtaagccagcaggctggagactcagggaagagctgatactacagtcccaatgtgaaggccatttgctggtggaattccctcttcttcagtgaggttagccttttcttttaaggccttcacctgattagatgaggcccacccacactaactggggtcatttgctttgccgaaagtctcctgctttaaatgttaaacttgggccatgtgtgggggctcatacttgtaatcccagcactttgggcggctgagacaggaggatcacttgagcccaggagtttaagaccagcctaggcaacataggcagacctccatttctacaaaaaaaattttttttcaattagctgagcttggtggcgcacatctgagatcccagctactcaggaggctgaggtgggagaatcacttgactctgggagtttgaggctgtagcaagccatgattgtaccactgctctccagcctgggtgacagagaccctgtctcaaaaaaaaaaaaaaaaaaaaaaaagaaaagaaaaaaaaccttcacagaaacatctagaataatatttggccaagtatctgggtgccatgcctatccaagttaacacatgcaattaaccatcacagaatgtattaaaatatttaaattacttttctgtggggtgctttgtttgtgaagcaggctgtacaggattattaaacattctgggggaaagattgtatttaaatcatgtgaagtctgaggggctgtgaaatatgcaggtggtgatggcaggcaggcgattgcacagcaaatccggagctggatgggagagcagagcttgaaacacagatctgggggtcgtccatgaagagatccatgctgtctaatgcaggttcctgggatgatgggaatgttgtgtatctgcactgcccacagggcaaccaccaaccacacctgcttttgagcacttgaaatgtggcagatgtgactgaagactgaatttttaatttcaattttcatgttaaataaccacatcatgtgtggctgccatgttggacagcatgggcacaaatggaatttaaagccattaagagtggaggagagcacccagtcccttggtcttagggaagcatacagagggaggaccgaggaacacacctgggaaccccagtgtttgttgtggaggtagaggaggaggacacagcaaaggggaccaggaaggagcagccagagaggtggcctgagctggggccacaggcttcagcggcctcacgggtcacaggtgtcatctatgcatttattccctccctgccctcttgatgtcttagtgtctgcttttctgatacgatgttggagagataactgaggaaatagtgggcataaaagcactgaaaatagtcagaaggcctttctaacactgtgctgggtgaagcccacacatgcacacacctacgtcctcctgacagtgtgtgtgcgtcactccctgcagtcatccagacagactggctgctttgtccttgaatcagcatggctgtattggaaaattatggacctaaaagtgtttgttctcaggctccaaattgtgagccttgcctcctgggccagagcccctgtgtctggccctagtctctgcgattctgagcgcagaggctccgccagctgcccaggcctcccgcagccgtggcagcatgcagtgggggcaggctgaggccatggtataggcccctgctccctacatgcagggttgaatttcttccccagaccaatcacccgaccaccagggagtgtgtaaggcagcgtgtggaagactgtgggtctgtgatgagagtctgagtcagccctggatgtctggaatttttcattttaggatctgtttggcctcacagtaatcttgaattgggttgtgtcccagagcctaggattttatttgctaattacagcccgtttgccactctctgaaggaacaaccagcctcctgtttcctaaatgccccatcctggccacactctggaggagccacagtggctgcagtgacatttcgccacttcttggtgtgtggcttgccctgggggatgctggcgttctttttggtgagagaggccatatctatcacagttacgggtgtgggttttcaaagtaacgtatcccaacaggcagactcgtaccatataaaactgagcacacggggggaatcttactagagcagagaggggaaagagcaggaaagatttcctaaaagtgtgttagaagctgggattcacagggagcaagtggatgtgaatacagcacataccttgggtcatcaggatgagaggcacatgtgtccagccccagcctggagccgtgttcccctatgtgctcagtgccagggcatttttttttttttttaatttacacttacatcagaaagggcaccaagagaagcctttaatgtttgtaaaactattaaaatcaaaatctaaaaagtatgtgatagagttgttgatagcccagaatgtatagaaattatgaggtgtccccacctggatggaagcaattaaactatgtctgacattggtattaagtagagaatttctgataaaaactaacaagcatgtcttctatgatagtaaagagatatatgatcacagggtgcgatttacagtccatgaaagattttgtcattttgttgttgttgttgctgttttgagacagagtctcactctgtcacccaggctggagcgcagtggtaccatctcagctcactgcaacctccgcctcccaagtccaagcgattctcctgcctcaacctctcgagtagctgtgactacaggcacacggcactacacctggctagtttttatatttttagtagagatggggtttcatcatgttggtcaggctggtctcaaactcctgactttaggtgatccacccgcttgggcctcccaatagttctgggattacagtggtgaatcactgtgcccagccatttttgtttttattgttttcagtaaaaagatagggcattcacttgtccgcctttgcaactctctgcttagtccagacggactcaggtagtggactggaccttgcttatgtcagtatctgaaatgaatgaagtgtgaccctgagagggggaactctaggattggcatctttctcccgtcggttttgagtgtgaggcccaacgggcccaacccctcaatccctgctggtgactaagagttttgccacaggttgggcacttaggctgtcctggaactggaaggtcccaggcctgcaccatcatcccccgaccagggcagactgaagcagtgatggcgtcaccctgcccggctcctgtgggctgagctgcatctgaagcttacagcccgtgggggaagtgaggcccttcggagctgctgcttgtctgtggcttctgcctcccaggtggcctctgcacagtggtggtgacagtgatcaaatgaaagagcattgggataataacacttggtcacagatgttctgctgctgcaaaaatgaataaaagttactgttgtgaataaaaaaccaccccctctctgtattctatgtcaccctgtatactatttcagggtattttgagacagtttttcatcaagggatcctcccacctcaggcttcagagtagctgggattacaggcatgttgccaccacgtcttgctccgcttgtgttttcacaacagatactgaacatagaagaaacagcatgcagcacactgtgaaaacacagcggtgccaggcgttgtggcaacatgcctgtaatcccagctactccagagcctgaggctgggggatcccttgagcccaggattttgaggctgcagtagtgagcccatctaaaaaaaaaaaaaaaaaaaaaaaaagaggaaagaaaacaagtggtttcattagaatcaaactagaaggtttttgcataaaacgttgagtttaaaaatgctttctcgttagaccttactagtaatcaatacaaattaaaacaataaaatatttttagcctgatacatttggcagagacagtacaggaaaatagccacttatacactattgctggagccaaaaattggggtaacgctctagaaagcaatgtttggcattacatattaaaagccataaaatatttgacttctggaataatggtggcctaaaaactggctaaaaaccaaaaggactgaagtaaacacaaagacctcaatagcaccaaaataggagattgctgccattaatttgggctaaatggaaggaagccaggagttcacagctcccctctcagcagaacagagtagtgttagggtaacaagtgtgcagtttccagcccatgcccgctcctttcctttaatttcaaggaaggggcatggcagcttgggcaggatcaccacagatcaacagctttccaaggcatgggccacagactggaagaaaatgtggtggctacatctttctgtttttttggtgacctggtgcctagagtttgcttcagtgtcagggaaaacccgtcgcttcaggctctagatgttcaagcaagggtagagagtgagagccgtgggggaaatggaaaagggtataaaatgatgtatgaaatctaaaatacataattatgtataaaatctaaacatacaaaattaagaaatttggacaggtgctgtggctcacgtctgtaatcccagcagttcggaagactttgacaggcggatcacctgaggtcaggagttcaagaccagcctggccaatgtggtgaaaacctgtctctactaaaaatacaaaaattagccaggcgtggtagtgggcgcgtgtagtcccagctactagggaggctgaggcaagggaactggttgaacccaagaggcagaggtggcagtgagccgagatcgtgccactgcactccagcctgggtgacacagcgagactccatctcaaaaaaaaaattaagaaattctactgaggaacataatggccaggtgccatagctcacacctgtaatcccagcactttgggaggctgaggtaggcagatcgcttgagcccaggagttcgaaactagcctggtcaacatgacgaaaccccttctctactaaaaatacaaaaaaaaaaaaaaaaaaaaaaaaaagccaggtgtggtggtgcatgtctataatctcagctactgaggtaactgagaaacgagaatcacttggacctgggaggcagaggttgcagtgagctgagctcaagccactacactccagcctgggtgacagggcgagattccatctcaaaaaaaggaaatttcactgaggaacttaaaactgaatatgtagagaaacatttatatctcaattatacttaatataacaatttaattttaatataatcctaataattttgaaatgaattttggaatgggagaagcatgaacaaatgattcttaggttcatctagatgaacaaacatcagagaatagccaggaagagtccccaaaagaagccacacactagggctgaatgattgtggagcactaccattaacattctaaggggaaattattttcagcctcagattccctgtccagccagcctgttaactgaacgtgatggtagaaaggagaaattttcatacatccagaaaatgtgtctccccatattctttcttaagaaggaacctaggcaatagaatgggggtaaaatccaaaaatcagtgaggttctggagggcttggggctgtagggtttcatagaatgatgagatgattaagagctcgaggctgtgataaaggagaagatgagaaactgtgcgaggaagccagggtccaactatgaggcaggccctctgtgtcagaatagaatggcggcagccacaaggagaatgttaggacttaaaagcaacagtcagaatgggcaagaggccagatgagaaggaggcacaaagcccccctcccagtaaggaaaaccccaaacaagcagaaactgtaggaaaaaaacaaacttttgaagaaaggcagggtccaaatctggggcacactaaaatgtggggtgattttgggcgactggtagagtaacagaggaactcctttaaatgatgctttgagtggctcaggtcatgatggtggagctgtagaggacacgtgcccacagctggcttctgtgatgccgcttgtggttttcagcttccagaatcattctagtcagagagcgccgaggacttaaatgtgcttccagggaaggaagcaaaggttctcagctgtgacaatgtacaacttgaccaggtggagggaagaaagggtaatttactcctgacatacaaagtagagtcaggaagtgttgtccatacccagtgggacaaaaaatagaagttcaaggatattatttaaggtcacaaacatagctaatattaatacgggcactaaaattagctatgtgtctatagtgtaaggaggaggcagatgcatggtgcctgagtcctcatatgtcctggaggaagtcagtagaaaatgccttcattttagaaatcaagtagtagtcgtattagcatattacagagatacggaaataatccataactaaacagaaattgaaaggtagttctctgaaggaccaggattgaaggaaggaacaggttttcatttgatttaaatacaatctatatatactataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattgacatctgtttgccgaaagtctgttgctctcaatacctaatatagagttatccagttgatataatcacatatcaacatatgatttagagattttcaatcgcataagatttcatatggacaaatttcagttctggaaacacagtggactgaattattattagagccctcttgttcagaacacctagaaatctgaataaaatgctatgttaaaaaatatcaacacatagctaagctcttaataaagaatgggaaatacccagatgccagaaatgtaaaacaaagcagaaaccaggcacaactgagcctgcaaaactcggcaggggtgggtgggggatggtgggccaagcaagcagcaagcctgcataaagccaaggctcacaacatgctgatcttcttagtgaaagcagaaatctctaaaactccaccagccagcccagggaggtgataaggaagctggtttccacctgggattgtgtgcgcacgtgcgcgcagagagaggaaaaggagagagagaaaagagagagagtctcttgcaaggaaaggaaacagggccagatgaggtttagagtccaaatttataatatctgtgctgcatgaagcccttagtatactcttagatgcaggaagcccctgggctgatactacaatggctgctaaaaagtaacagaacacttgagaaaatgatctacttgagctagtcagcagatatagcaaacaaaaggattatctaccagaacttgagatgataaataagagactaccaaaagactatttaaacatgaaagagataaaaggaggaatagaaaccacaaggaaagaatgattctatttaaaaaagagatttgtaaaaagaatctaacacttctagaaatgaaaaattggaattaagaccacaatatgtgttgccaaactcattagatacagcagaagagagaaatactaaattggaaaataaatacagggagatcacccaaaatataaaagagacattaaaaaatataaaatataatggtaaggttgaattagtatgtgttcagcttcaagaaatggaaaacccaaccagcagttgcttaaaccataaaaatgttaattttcttaacaatagtagttttagaactggttcaccactcagtattgtaatcaaagccccagagtgtctcctctccattctcaccatctttaatctgttccttttgtccccatgcttgttctttgtggttgaaggtggctgccaaacttcagacatcacttccacctacagggcaggaagaaggggaagagagagagcaagtgcctcctatctttccctttaaagaatgaaagtgaaaggctccctgggtttctccagctcattggcagtactctgttacatggtccccagctgcaagggcatttgaggaagtgagcatatgaacagttttcagtttctttagtgggaagcctgcgagggagagagcttgggaatgactgttgggctatctaaataatagtgtctgtctcagagtttaagagacagggacaaaaaaaatcagacaatggccatgtcccatgcccagagggaattccagatgaaaaggatagaaagaatggaatggagacagtatttgaagatatgatgcctgaaaattttccagaatgatgaaaggataatgaaagagtccacagattctttatttatctcaagcaggatgaataaaacaaaatatccatctagacatattgtaatgaaactacagaaaaagcaaagacagataatctattaaaaatttctgctcaccagtaataaaaatacaacctagtaggaaattatcaaagactagaagagaaaattcacagatgatgatgatgaatggtcaatgaggatttttaaagatgttcaatctcattagggattgggaaaatctaagttgaaataaaaatgagataacaattccagctgggtgcagtggcccacacctgtaatcccagcactttgggaggctgaggtgggtggatcacctgaggtcaggagtttgagaccagcctggccaacattgtgaaagcccgtacctactaaagatacacaaaattggccaggtgtggtggcgggcacctgtaatcccagctactcgggaggctgaggcaggagaattgcttgaacccaggaggcagaggttgcagtgagccaagattgcaccattgcactccagcctgggtgacaagagcgaaactccatctcaaaaaaaaaaaaaaaaaaaaaattccataaccctcaaagcatgtggggaatctgagaaatgaaaaagtgaatgtacatctattgtgaaatcttaccaccatgaacagtgctatgccagtgtaattttgaaacagaatggacagttttctagaaaaatacaagtatgtttcttcaaatattaaatgtaaatattcctatgaaacttaagaagacataaaactttaaccattgaagaggttgaatttatgctttaaaatgtagtcacacacacaaagaaaaaatatccccatcagcccagattttgctaaatctttaagacgcagatatccctattgtgtatttacaagtctgggaaatttaaaaaggtgtgaggaaacttacacatctgaccagggtggagtagcagggatctcccttcagaaacaacaaaactaaggagtaccaacagagagatcaggtaaggataaagatacaatgagaccttgttggaagattatattttacacagaatacatttttctttgtagtgttgtaattaatatttacttctgtttaaatataatatctttttcttaattttcatctaatgtgctatagaagttagtgagctgggaagtgaatgaggtcattttgttgtcctaattgtcagagccaggggtttcattggtgtggatggtctgtgaggagctgctgacacacatgataattaatctcaaaggcacttaggagtgtttgtgagcactttcccggctttttccaccaacaaaatagaaatttcctacattcttaaatttgcttttcagtaccttgatgtggattggaaaatccagtatgttgaattacacatgacactttaaaactacacccagtcagaagtgacagcagtaatccccaaatcttcagtcaagttctgttgttagattatgccaggaaaattgtcttatatgtttatattcaagtaaatataagtttctggggtataacatattaggatgagatctttatttttataatttcaacttttattttagattcaaggagtacatgtacaggtttgttacatgggtacactggatgatgctgaggtttgggatatgagtgatcctgtcacccagataggcacatagtagccgatagtttttcagcccttgcctccctccctcctttctccctcttgtagtccccagtgtctactgtccccatctttatgtccatgactacccaatgttgagctccatttataagtgagaacatgtcttatttggttttctgtttgtgcattagtttgctgaggataatggcccctagctgaatccacgctgctgcaaaggacatgattttgttctttttatggctgcatagtattccatggtatatatgtaccacattttctttatccagtctactggttttctttctccttttcttttttttttttttttttttgagatggaatttcgccttgttgcccaagatagagtgcaatggtgcaatcttggctcactgcaacctccgacttccgggttcaagcaattcttctgcctcagcctcctgagtagctgggattataggcacgcaccaccatgcccagctaattttttgtattttttttagtagaaatggggtttcatcatgttagccaggctggtctcaaactcctgacctcaggtgatccacccacctcagcctcccaaagggctgggattacaggcatgagccactgtgcccggccctttatccagtctactgttgatggacacctaggttgatttcatgtctttgctattgtgactagcactgtgatgaacataagtgtgcatgtgtttttgatagaacgatttcttttcttctggatatatacccagtaatgatattgctgagtcaaatggtagttctgttttaagttctttgagaaatctccaaagtgccttccacagtaactgaactaatttacatttccaccaagagtgtattcccttttctccacagccttgtcagcatctgttactttttgacgttctatcaatagccattctgactggtgtgagatgatgagatctttaaaaatgaagctctatagtgttccccagatattagaaagtgttctttctcagccaccgtgtaaggagagcatcttagccagcccaattacagatgcaagcaactccccagaaaaggaattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgcaaggtggatgcactctataagaggaaactgaggcacatggcttatgagcgggaaaggcaagaggcaaggccaggcaggcagctccagagcgcatgccgtcaaccaccctgacagctgtgtctgccttctgcacataccttgttagatttagaccttagtggggtttttttttttttttttttggtgctattgtaaatgttattgtttttcttattacaaaatccagttgttcaattggtacataggacagcaatggacttttgtatactgaccttgtatcctgagacttagctaaacctgcatgtaaatgctttgggatttttctaaacaatcatatcatctgcaaataaaggcagttttatgtctccctttccaatctgcgtgccatttgtttctttttcatgccgtttagcactagctagaacttccagtacattttttttttgtttttgtttttgtttttgtttttgagatggagtcttgctctgtcacccaggcctggggtgcaatggcatgatctcggctcactgcaacctctgcctcctgggttcaagtgattctcctgtctcagcctcctgagtaactgggattatagacacctgtcaccatgcctggctaatttttttgtatttttagtagagacggagtttcaacatgtttgccaggcctgccttgaactcctgacctcaggtgatccacccgcctcggcctcccaaagtgctgggattacagtccagtacagttttaaataggacagatgagaaaggacatccttgccttgttcatgattttacggggggaatgttcaggtctttcaccattaagtatgatgtcagctgttggttttttatacatatcctttgctaggtaaaagaggttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaatagattgtgtattcatgagaaattggcatgtagatttcctgtaatgtttatgtctagttttggtatcaggataatgttgggatcctggaatgagttgggaattattctctcctcttccattttttgaagagattgtgtagaattggtattatttcttccttaagtatttgatagaattcacaagtgaaatcatctgggtctggtatcttttggagggtcttaactactaattcaaacaaatgtcatgcactataagattgttactaatgcagcatactctgtcttctgaaatgtataacatcttttcacaaattctcaaatatgttaacaatgtactaaatatttttagttcagttatgaagttcaagcatgtaagattgtctgctcaaaactgaatattgattggacttcggagtcctctctgagattaaagacacaccctttccataatacagaggaaagtgtgcagtgtgccatctctcttgtgtttgtaggtatcccttcttttcccagagctcatctatgtccaaattgcatgcccaattcttcatcagttcctttctgtaagtcatgttagcaacactccttggtacggattttaggttgccaggcctcagtctgtgtgcagtcatgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgcatgctcattacaagcttacttgcaaaatgaacaaaaataaatcagtcagtaaaaaccagcaaattagcaaaagtaaaataaaaataagccaaaaaatcaccaaactgtattaaataacaaacaaacaaaaaaacacattaagtagtaacaatgctggtaaaataaatggttgcatttgaaattggttcaaggcttttgtgataatcccactcagtaatttatcttgagggactagttcgacagaaggaaacaatactgcacaaagatgctgattgcagagtctgtggtggtcacgaggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaa

SEQ ID NO: 496 - DNA, 83438 bp, Homo sapiens
cagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagta

SEQ ID NO: 497 - DNA, 43707 bp, Homo sapiens
ctaaggcgctgcagtttctttattttttctttttatagagatggggtcttgctgtgttgcctgggctggactcaaacttctggggttaagcgattctcccacctcagcctcccagagtttgcagattacagccataaaccaccgtgcccagccctctgcagtttctaaaagaggttcatcaatacaaattctcagcatcattctccaattaggctcccccattaaccaattgtttctaatgaccgattattaatttgcaagagaattcttcctctaactcataccatcccactcagacagagttcagtattttccttcactttaatttttattgcttctccagttcagataattcagcgcttcctctttcttcttcctcaccttgttcatggctggctgttccatcagcagaactacaaaaccagaaaggcaacaaaatttgaaaggtttctcggcatcctccaaggaggctgtgggggaatatgaaaaagaaggtggtgtctggagccacacagaccagagtccaaagcccagctctgccattattagctgtgtgatcttgaacaaatcactcacctgtaaaatgagctcataaagcttgtgaatgtgagaatgatatcaggtaataaatgaatggcaattcggtgccaggaatgtgctgagctctcaatttatggtcaagaacatcactgggatggctactaatcacttggttagacttttggtctcccacatggcaacggagaccaactgaaaatgtgttcagaagtctgtagttgttacctctagtggatcctgtccctccaactagtaagagtcaaggaagaggagctggatttaaagcattcagaatgtcctttctctaacagtaacaaaatcacaagagctacatttattgagcatttattctgtgctaggcagtattaacatgtattaactcatttcacccttacaatcactctgagataggcactaatatcactcccaattttttttttttttttgaaacggagtttcacttgtcacccaggctggagtgcaatggcatgatcttggctcaccgcaatctccgcctcctgagttcaagcgagtctcctgcctcagcctcccgagtagctgggattacaggcatgtgtcaccacgcctggctaattttgtatttttagtagagacggggtttctccatgttggtcaggctggtctcaaactcccgacctcaggtgatccaccggcctcccaaagtgctggaattacaggcacgagccactgcgcctggcctatcactcctatttttacaggtaaggaagcagatcagagaggttaagtgacttgcccaaactcccgtaatactagtagatgacatacccaaaatagtaagaatagtggttttatgtaccaggcatgtctgtactcagggctttttttgtatggttgtataatttgttgactgcacaaaagagcctggccaaaggggcaagctgaggctgaaacgtagcccctgctctgtttgctccgtaccctggcatgaggctgtgccgcctggaggaagggacacctttttctaatttgacaaagatgccatatgagctctcagaggctctgttaatgctttatgtgtgttaccttctctactcctcaaaacagctctgtgggctagatatgaataccctcattttatagatgaggaaatccaggcttagtgagttcaggtcactgagttaagtcacttggtaagggataaagctaggatttgagcctgatgccaaagcccatgctctaaaccagtaggccactatactggccccatccctaagtgctcaataagtgaaaaaaggaaaaaatacataatcatctggtttttaccttaaaaaatatggcagttctaatgaggccccagtaagggctactgaggtccttagtaagaaaaataattagaggccgggcgcggcggctcacgcctgtaatcccagcactttgggaggccgaggcgggcggatcacgaggtcaggagatcaagaccatcctggctaacacggtgaaaccccgtctctactaaaaatacaaaaaaattagccgggtgtggtggccggcgcctttagtcccagctactcaggaggctgaggcaggagaatggtgtgaacctggggggtggagcttgcagtgagcagagatcacaccactgcactccagcctgggcaacagagcgagactccatctcaaaaaaaaaaaaaaaaaaagtaaaagaattgatcaggaagtcggagcatcggctttcagtgctccaaactgtggctttatgcttattaactatttctgtatttcaatttccttgtctgaaagtaagaataacattataaaggaacaattcttgtagttgtttgcaaagtgtttatgcatacatgataaccctcatatcaaaatgatcctcacatcatcaaacctgggagaaaggcattattattactcttttgctcaatgaggtgagtaacatgctcagcatgagtagggcagaatgggacctgaaaccagggatcctgacttatcttgtacttcttgctaagtaccttagaacttttggagcacctgcagcctgcctggtggcccagacatcacatggtgcacatgcaagtcagagagcagttggaaactgacaataggcacgtgaccacactctgttccttcaggagacttggcaggaaggagcactctgggaggagtctttgtttggctcccatgcgtgaaaacaaaacttctgcctttgcaggagctggggcagtctgagttacagacttgggtaagactttcagagcttccttaggagggaaggatggcctggtggcatttaggttcaactcctttctgacagggctcagccttcctgtttcccatccttggctgtggccaggttcaaaggaaataccatctgtggaagcactttccaaagaggcgtggtccaagtgcagaatgtttttcctctcctctgtggatctcaggaagccgattccatctgtgctcaaatgacagacttgctcatcctgtgataaaatgtgggctgctgcccccaccccagcttggtgcccttctaaaatgaaaacatgcatgtgtgttctctccccacctccccaacagcaatccgccactatctctggctctgcagacctactctgtgcaggctggcaagtgctgccatgcacaaggccccttctgggttgtgggtacactacgccttatgcgggcgaggtatgtggataacagggaagggggaaatacataaacatacagaccttccagcgattgccacattcattgcataagacaaaggtagtcatgggctcatcagcactgcgtgtctgcacctgagagagagaagaaccactcatgaagtcactcccctgttctaggacctgccatggctcccactgtctttaggagtaggtccaaatcccagaggttggcactgagattcccaccccccgctggcaatttccttatcactgacaactccataatattagtattatgctttcctctcctctggcaggcagtccatcagctcactcccagtatcttactggcttaacctggccttttgcacttccgctttttttttttttttttttttgacagtggagtctcgctctgttgcccagactggagtgcagtggtgccatctcggctcactgcaacctccacctcctgggttcaagcaattctcctgcctcagcctcctgaatagctgggattacaggcgcccgccaccacgcccggctaatttggactttcactcttgttggtcactcttgttgatcttttgtaacagacctctcttctcttgcctcaagacttatctcctacaggaagtattccctgactcacccctgaacacatcctactggacaagttcacaggagtgagctgcaagcaggcttagcggtctagttcatcttccttattttactggtggaagacctgaggcccagagagggaaagtcctaaatatcattgggactatttaatgttacattttctcatcctcttagcctcatcattcaggtgcaggaaccgggtatcccacagtaaagccctggcatttccaggtttaacagctcctgttctggttttctaaggctgtccttggctggccacgacatgtagcaagtcattactttgctgacaatcagctacgaatgatgtcagctgggaatctgtggtgtgggacgagttatgcccgccaccctccttgggtgagccccagcagcccagcagtctgccaggcggacacagcttagcgcagcctggtcactggaaagcagtgacgagcagagagaaaactttgctagtgggcagtttacttctagaaagaagtgaggcacaggaagcgcatcactccacacggaaaggtgcttgggagagagcagaagcttgcacaaacatctccggattccagaactggaattctccaagggactcctccggaatggcaaggctgactgcatttctgccctggccacagaatgccgcaggcaaggtgctcttgataaatggtgtgtgccgaacagacggagaactctgaatagagttctagaatgactagacaccagttagaatccaaggatatttgtgctctaagggcataccatgtgcaacccagaaagaggaggccattctctggttttaagagaaggggcctccacagccttcccaagttccccatgccagggcaatggtcttcaactttaggactcagagctaaagcccttaggctttattgaccaagttagctggattgcaggcagaatggtgtggatcttgtttattactacctctgacattggcctcctttcttgggcaaggctaaaaagcccatctgtggcctgtgtgggcctcagtttccctgggtgtgtaatgagggagctgggtttcacattgccaagttcccttccaactgtctatgactcttcagccgccatgagtctgattcttcttattgtcacgtcagggcagaccagaacacactgaccaagcctcgtagacacatagcagggatgattctaaactcagaggaacattgtctagaagccacaggtgcaccacattagtgtaccaaggcttgcccttctctctgcagcctggagagtttttaaggttttctttgttttgttgagtcagggtctcattctgtcacccaggctggagtgcagtggtgcaatcatagctcattgcagcctcaattcactgtagcctcaacctcctgggctccagtgattctcctgcctcatcgccacccatttcccccgcatccagtagctgggactacaggcacacactaccaagcctggctaatttttgtatttttagcagagatgacgtttcaccacgttgcccaggctgctctcaaactcctaggctcaagcaatctgcctgcctcggcctcccaaagtgctgggattacaggcgtgagccactgagctggcccagcctagagaggttttctttttgttgtttgtttggtttgagacagagtctccctctgtcgcccaggctggagtacagtggtgcaatctcggctcactgcagcctccacctcccaggttccagtgattctcctgcctcagcctccagggtagctgggattacaggcacgtgccaccatgcctggctaattttttttttctttcagatggagtctcactctgtcgcccaagctggagtgcagtggcatgatctcggttcactgcaagctccacctcccgggttcacgccattctcctgcctcagcctcctgagtagctgggactacaggtgcccgccaccacaccctgctaattttttgaatttttagcagagacggggtttcaccgtgtttgccaggatggtctcaatctcctgacctcgtgatccgcccgtcttggcctcccaaagtgctgggattataggcgtgagccaccgcgcccggcatttttgtatttttagtagagatggggtttcactgtgttggccaggctggtctcaaactcctggcctcaggtgatccactcgccttggcctcccaaagtgctgtgattacagacatgagccaccgcacccggcaaagcctagagagttttaacgctttctcccctctggctcttccctaagcttctctctgattttccacctctatgcccctgcggcctcctgcacctccggcccgtcccctcactgtccttacctggttataggtgcagttcttcttcttgcatttgctgcactggaagaggtcagtggtggtgccgccagtcttggccatctggtgctcacggatggcctcctgggtcatggcattcctcaactccctcagttcatcactggccatttcctggagaaaaaagagtctacccttcagggctgaggagtttcaggggccctgccctacacccggtttctagaaagcctgaacagaaaaggaggtaacatgctttattgactgcaaggagctggaaggaggcctggattccgggtcctgccccagctgggagaaagctgtccccgcagagtcctcctgccgcccacggctggaaggtcataatgcacattcaggtgagcagcaggcaaacagcctctgcccgaggacgagcactcctgtgtacatttcttcagatctggggctcatcctgcctgccaggaccttggccttggcctgaaccttcctgcttgagctgacttgatcactgccacctggtctatgatgttccccttagccttcctctctagacttgacccagtgctcttttacgctgtgatcactgccctgctgttctgcttagtgggaaccttggcgcaactacccatgacttgctgctgctacccccatcctgaagctcctgggctcacacaactaactgttcatctgatgagcatgcatccaagatcatctttttctgagagtttctacagaagagtctccagtctcccaccagctcacagtagacactccgggtctgcatcacccacacctttgctttctctgtccatctccctggccacttgtctccccttaagcctctgccagaggacagcagagagggagctccagttaagggttggtggaaggggaaggagggtggctgacgcgaatctcaaaatgaggattttaaactttttttttttttttttgagatggagtctcgctctgtcaccaggctgaagtgcagtggtgcgatctcggctcactgcaacctccacctcctgggttcaagcgattctcctgcctcagcctcccgagtagctgggactacaggctcatgccaccacacccagctaatttttgtatttttagtagagacggggtttcaccatattggccaggatggtctcgatctcctgaccttgtgatccacccacctcatccttccaaagtgctgggattacaggtatgaaccactatgcctggcttaaacattttaattgttgctgtctgtcctgagtccttaaaccatggagaagaatgctggcataaaggtcaaagcattttagtgtgctcacctttcattataaccacttaggcttcttgataaaatgcagattcctatgaatctgaattgctaagggcaggcccaggaatatgcattttttaaagttctttatttggttatttttgggacaggatcttgctgtcacctaggctggagtgcagtggtgcgatcgtgactcatggcagcctcaacctccccaggctcaaacgattctcccacctcagcctcccaagtagctgggactacacccagcatgcaccaccaaacctggttaattattttttgtatatttttgtagagatggggttttcccatgttgcctaggctggtctcctgagctcaagtgatctgcctactttggactcccgaagtgccgggattacaggcatgagccactgcgcctggccagaatatgcattttcactagtgtcctcaagttattctggtacgtattaatgtttaagtcctagtgtgttaaattcaaaggctaggccctaaccaatggcaggagaatatagaaaaacaagtcaatgaaagccatttacccatatgagtaaaaagtagctgactttaatttgaggggattttccagagcataaagcatttgcccattcaaaatttattggatgtggccaggtgcagtggcttacacctgtaatctcagcactttgggaggctgggacaggtggatcacctgaggtcaggagttggagaccagccaggtcaacatggtgaaaccccatctgtactaaaaatacaaaaaattagctgggtgtggtggcgggcacctgtaatcccagctacttggaaggctgaagcaggacaattgcttgaacctgggaggtttaagttgcagtgagctgagactgcaccattgcactcccgcctgggcaacaacagcgagattccatcaaaaaaaaaaaaaaagccaggcattggtggtgcatgcctgtaatctcagctatttaggaggctgaggcaggagaatcgcttgaacctgggaggtggagggtgcagtgagccgagatcacgtcactgcactccagcctgggtgacagagtgagactccgtctcaaaaaacaaaaacaaaatctattggatgccaatttactgaatgcctttaactgtatcagtttgcaggtaaaccagctttggttgtggggatgccttgatttgtagtgtttgtcagcttccatgggacaaaatgctatggtcaatgggacaaaattccatggccaatttcaagctgctaatgtgatataactgaacgcagagttgggaagagctacacatcaccagctcccttgagctggtaggagctagctcaagcatgctactgcctctgagtccaacggattcagaaaggaagatctggttcctcctcccaagtagtgctaatctgatagggtagccaagcatttacacgagattgcaagagagggaaggaagtactaaagtgaaggcatataaggtgcaggggaaagcaacagggtatggtggttaactgtttggggtctggtgggtcatgaagaagctagtactttaaccagtcttgaaagataggagttcctggggtgggtggtggcacattccagacaaataaaacagcagggccgggcgcagtggctcacacatgtaatcccagcacttcaggaagccgaggcgggcagatcacctgaggtcaggagtttgagaccaacctggccaacatggcgaaacttcgtctctactaaaaatagaaaaattagccaggcatggttacatggttacaggtgcatgcctgcagtcctaactacttgggaggctgaggcaggagaatctcttgaacctgggaggtggaggttgcagtgagctgagattatgccattgcactccagcctgggtgacagccagactccatctcaaaagaaaaaacaaaaaacaaaaaacagcaggcacaaaagatcagaggacaagaatagcatgtttggggaaaagtatttggggtaggttcaagtcaagcatgggagatgtggctggaggtcagattgtggaaggaaggtcttgtgtgccagctaagaaatagagaacagaaaaatctatccagccacacgccaattcattgacttctctgccctgcctcattagaatgaggcagcatcagagacacggagaataaatacaacactgtagaaaataaggtggaaaatgaaggaaatgagagtcagagaccacaattctatccctatttgttgagccctgtgatgtaccagacactgttgtcagtgctgggtggactgtgaatgccggttctcaggggactgacaggatgctatgtccactcagcagcgctcatgggtatctcagagcctactccattctttgctatgtctgagtagggaagaaaagagaagaagaaagaatgagggagtcaggtaaacaaggaaagaggcataaaaagggagtcagggaagggagttctgagagagacaccgtccacatgggttcctgatgggcgcttcccctcacagcaggcagcccaagcccaagctaagatttttctgtttttttttctttttttctttctttctttcttttttttttttttttttgagatggaggatctcagctcactgcaacctctgcctcctgggttcaagcgattctcctgcctcagcctcccgagtagctgggactacaggtgtgtgccaccacgcccggctaatttttgtatttttagtagagacagggttttgccatcttgaactcctgagctcaggagttctgcccacctcggcctcccaaagtgctgggattacaggcatgagccacctcacgtggcctgttgaaatcctaaccccaaggcaatggttattagggggtctttgggaggtgattagctctcaagggcagagctctggtgcaggggattagtgctcctctaataggggcctgagaaagacccctccaccatgtgaggttacagtgagaagatggctgtctatgaggaagcaggccctcactagacactgaatctgctgctgccctgatgttggactgtccaatctctagaaatgtgagaactaggccaggtgtcatggttcacgcctgtaatcccagcactttgggaggctgaggcaggtggattatctgaggtcaggagtttgagaccagcctggccaacatggtgaaatcccatctctactaaaaatacaaaaattagccgggcatggtggcacacccctgtaatcccagctactcgggaggctgaggcagtagaatcgcttgaacctgggaggtggaggctgcagtgagcccagattgtgccactacactccagcctgggcaaaagagtggactccatctcaaaaaaacaagcaaacaaaaaaaaagaaatgtgaggaataaatgcctgttgtttataaactacccaggcgatgttcgttatagcagtctgaactgacgaaagacacactgtaaagccaagttgcaatttataactccaggcatatgttgctatttacccaaaaagatcagatattttaaattaggcagaaagataaccctggtctacctgtgccaagttccccatttcatcctaaagccaaggctctttgctgtttgttttgggtgtttgaggaaagcagtgaaccctctcctcagaagaatgtacatacacacactacataacacagacacacacttccacatgccacacatacacaaaccacacatgccacacatatgctaatcacacaccacacacatacttcacatgacatcatacacacacactccacacatcatacacacacactccacacatcatacacaaaacacactccacacatcatcatgcacaatacacacacactccacacatcatgcacaatacacacacactccacacatcatacacaccacacactccacacatcacacactcacactccatacatcatacacacatattccacacatcatacacgccacatacactccacacatcagacacacacactccacacatcatacacacacactccacacatcatacacacacacacacactccacacatcatacacacacactccacacatcatacacaccacacacactccacacatcacacacacacactccacatatcatacatgccacacacatatactatacaccaaacacacctcacacatcatacacaccacacacacacccactccacacatacacagcccccacactccacacatcatatataccagtggtccccaacatttttggcgccagggactggtttcctggaagacagtttttccatggacagggtgggggatggtttcaggatgattcaagtacattacatttattgtgcactttatttctattattattacagtgtgatatatataatgaaataattatccaactcaccataatgtagaattagtgggagccctgagatcccttgttttcctgcaactagatggttcccacttggggtgctgggagacagtgacagatcatcaggcattagattctcatgagaagcatgcaacttggtttcctcgaatgcacagttcacaatagggttcgtgctcctatgagaatctaatgccgtcactgatctgacaggaggcggagctcaggcagtaatgcgagtgatggggagaggctgtaaatacagatgaagcttcgctcacttgcccactgctcacctcctgttgtgtggcctggttcccaacaggtaccagctggtggcctgagggttagggatccctaatatataccatacgcacatgctccatacatacacacacatacataccacacatgcactccacatatacacaccacacacacaccccacatataccctctacacacctcacacatcatacgtaccacatagacacgcactccacacgtacagcccccacacatgccacacaacctagcgctggggccagacagcttgcctcctggctccgactctttctagctgtgtgcatgggcaaattcgtttactcctctgagcctcaggatcctcatctgtagaatggggataatacacctttctatctcagttggtgtgaacataaacttggccaattcgctgaacacacttagcacagcacttagaacctattagctgtgttcagtatcctgctagtccagagcccaggggggaggctgagatgaggctggtttgaaaagctccctggctcactgctgatgagtcacgagccactgaccctctgcactaggcagggctagggggacctggcttcctgcctcaccatgcagatgccctgctctcacctctgccgtcatcttggctataagccctgcggagatggccccactgagcacgttccgccgcaggccggggttcctggggtccttgaggttgcttatgcggctgcgcacgcggttccggtacttcatgtccgtgctcttgagctcttggtagatatgtgacacagtcaagggccggccagccattcatggaggggcacagaagggtgcaggcctggccctgacgcctgagagctccagaaccctttcttcctctcctcggacttctacaggagttgggcccctcttttgtgacctctgactctccaagtggtgatgtctcttgggcatttgtggtcagccaagtagcagagaaagaaaatagcttctggggtaagatcagatcatagcaagcactatagtgtcagggacaccaggaccctgggtttgtctgagcctcttgtgtgacctcaggtgagtcacacaacctctacacgcctgagtttccttatttataaaatacaaggattctgtgagctaagccacgtgatgcactagtgtggtgtctgggatatatcaaatgctcaacatgtatgggctgctaagatgatgacaaggatgcggataacttctagtttggaagggcccctggaggttgtgagtccagctgtcagaggaaaagattaagagccacatgtttaaggctctacgaagtattgcaaaaaagaaaccactgagctttgtttaatctggtgttcccaataaatttgattatagagtccccttcccctctgtcctttcccctacaagacctgttaccatcccatggaacccacgctgggaattgctggtcagagttacttctcccattaacagatgaggaagctggggcttagaaagggtgtaggaccttgctcaaggccaccaggcaaattcccggcagagacagggctggaagccagacccctcctgacggtaactctctccactcacccggcaggaagtcatccctggccaccaaccacagagtttctgtccaaacactgcatcctaggcaggcttccgagcctcccactccctccaccctctggaggagctcggggaacacagcctcattttcttggtctcctgagccaaagaagatcaggaagacaaagctgttgctgggaagagccatatacaataaagagactgcggagaatgtggaaaaatgaaaacagatgacttgctagaagtggtgggaggggaggtggtattctttcttttttctgttattgttttaatgttgtttgtacaataaaagtgtgaaaagcaaagaatatgccacaatgcatgtgaaagccaaaaaatgtgttttaaaatgtaccacttgggattcctggggtgtattgatatgcggagccagcagggctggcgatactttcaccagcctctttctgactctgtctccatgtcccaaggccacagaggggacgaggcagagagcagaccgggggcaccggcccctcagaggaacttttggctgcattgttagcacagggccactccaaagaggacagatctattttaggacatagagcagtcaagcccccaaatgtaccctccccctgacctccagctggctaaaaacaaagagctaaagtgtttgatgcagctttgatttcctctcctttagaagagggacattcaggctgggggtggtggctcacgcctgtaatcccagcattttacgaggctgaggagggaggatcacctgaggtcaggagttcaagaccagcctggccaacatggtgaaaccccatgtctacaaaaaatacaacaaaattagccaggtgtggtggcgggcacctgtaatcccagctacttgggaggctgaggcagcagaatcacttgaacccagaaggcagaggttgcagtgagctgagatcatgccactgcactccagcctgggcaacagagcaagattccatctcaaaaaaaaaaaaaaaaaggaactttcagtggatggaggaaaggctgggagtggaactttgtactggaccatctgctgttgtttcaaactgggcttaaaggtggaaaggacctgcttggagggatgactgttcaggagaaaatgaagatgaaactcgtgatagttctcataccttgtgttctgccttcttgaattaacaggaaatgatgaaaatgtactttttgaggtgctgaatggctccagacttgttgaggtattgctgattaatcattaaatgagagtagagagaaaccaccagaaaataagttggagggaatcagggtaggccacaggaagaagatggaaacgcaaatttgtcgtctgcagattggcccctggctctcctcaacagaccctgctgaactccgcaggtagaacccaggagccctcaaaagggtcgctcacacctcggtgtgacacttagacttcctgtcccctgactgtctccccgctccaataccatgcaaacctttgtctctagtaaaagaagctccatgttttcattcagtgggggccaagtggggtgggattttttttctcccaagccaaacaccttttggtgcaacagatctatgaatacatcccagtggtggccacctctcctgtctacacaaggcccctttcaggtgagaagttggggagcagggggcacatggaaaggattcaatacatggaatccaaagacaaagtctccagtcccgctttgacagttctgagcctcagactcctcatctgtaaaatgggaacagtccctgcctcacagagaatgctgtgagagctaacagaggtaggaagtgtcaattggccattgcagtgcttgatatatatttgggagtaaaaaaacagagggcagggcgctgggtgtgatggctcacacctgtaatcccagcactttgggatgcaaaggtgggtggtgcatcacctgaggtcaggagttcaagaccagcctgaccaacatcgtgaaaccccatccctactaaaagtacaaaattaaccaggtgtgatggtgcatgcctgtaattccagctacttgagaggctgaggcaggagaatcgcttgaacccagaagttgtaggttgcagtgaggcgagattgcgccatcgcactccagcctgggcaacaggagtgaaactccgtctcaaaaaaaaaaaaaaaaaaaaaagggcgctgttaacatcagaggatgggagaagggaaaaggctgagcatgggaaatgctgacctctcaatctagtctgttcctggaagtaacgacttggccaactgaggcacgctattacacagcctagctggcacagccgctgagcctccaggttccagggtcacaatttctggattcagatcccatctctgctactactgttagctgtatgggctttgggaaatgatttgacctctctgagtcttagtgacttcacccatgaaactggataaatcagggaacctactgtggggttgttatcaacactgaatgaggtactgctcattttcaagttttgctggcaggtgtaaaataataatgaatgttagatagaattaagaactctggttcaggggcagagcaggggctgttcccggagcccttcctctccttcctcactctcccagctcgcttgcaccttggatgggtgctgctagacggtgcagacacccacagccccggcacagttcaaggatatgatcttcgatttctgatgccatcttgtcacagttgactccatagtccttgtaatcatctaaaagagattcgagaaatacaggtatcagccagacacaacgtaggcagtgaagcctgcttgtacctgggactagagtgttcctgtaccatcccttggggtgctgagaaagactgaatttcatctgccctcagtgagattgggaaaagggactccttccctccctcatccctagcccaggctctctcaccgtccgccttcagggctgctgacagcatctccacacacttgtcccggacagagtcccctgtgagatagcagggggccaggagacacatggaagaggcaaacgtgggggtcaaggggctgctaggtgttttggggctctccgcttttgatttgctgctgtttgatctgaggatgacaataagtaacagacatttgacattaagagagtaaagcatttattgagcagcattctagatgtcttgatggatgatctcctataatcctcataacaacctcatgaggtaggtactattttaggcacttgacatggatcatctcatttaatcctcgtgacaaccccatgaggttgatactattctcatccccattcgagagatgcattttaaagtgcatggtagagaaagatgtatctaaaggtgcacttggctcagataacacatcgacgaaccagtagaaacagaattcaaacccaggcagtcggctcttaaccagccactgtgcgttactcattatagaacagtgtaacaccaccaataattatatgcaattgattaggcactgtgctagctgctctctatctatgctctcctaaatgtatgaactgtttattcactcattcactaaatatttattacaaacctattctccaggcgcttgtcaagaacaaaggataatgcagataagtcagcaaagctccttcccttaaggggcttacagtctagtgaatagtgactatctaccaccatttaaaagggctggctttgctagatgccagaactgtgccaggcactttaaaagaattttccaatttaatcttcatagcagtcccaggaggtatactctcatcatctctattttaagacgaggaaataaacccagagaggtacaccactgagatttgcctaaggctatacaccaccaggatttgaatccacatctgtctaattccaacatctatgctctttttattaatttattttattttttgagacagggtctctctctctctctctgtcacccaggctggagtgcagtggtgcagtcatggctcactacagccttgacctcctgggctcaggcaatcctcccaccttagcctccaaggagctgggaccacaggagcacgccatcatgcctggctaatttttacctttttttgcagagatgggatctcaccatgtttcccaggctgatctaaaactcctggactcaagcaatccatctgccttggcctcccaaagtgctgggattacaggtgtgagccaccacacccagccaacacctatgctataatctatgatgtactatctaagaattatctcattcaggttttgtttatatatatgtatatatgtatatatatatatatatatatatatatatatatatccatatgtgcacagacatttagaaggctaactatgtggctcaatctgtcataacaaaatatcagactgggaggcttcactagcagaaatttatttctcatggttctggaggctgggaagcccaagatcaagttgctggccaatttgctttctcatgagggctctctctttgcttgtgaatggcagtcttctcattgtattcacatggtgtctcttctcatagggacactaatcctattggatcagggctccacccttatgacctcatttaaccttaatgaaggccctatccccaaatacagtcacaatggggtttgggatttcaacatatgaattttagggggtcacaaacattcagcccataataccatgttaatagcaattatctctctgaggtggaatgataggagattttcattttcttcgtttgcttatgcctatttgctaaatcttctatacagaatttatctacttttgcgatgtgagaaaccttttttttttttttttgagagggtgtctcactctgtcatccaggctgccaggctggagtgcagtggcacaatcttggctcactgtaacctccacctcccggattcaagtgattctcctgcctcagcctacctagaagctgggattacaggcatgcaccaccacgcccagctaatttttgtatttttagtagagatggggttttgccatgttggccaggctggtcttgaacccctgacttcaggtgatccacctgccttggcctcccaaagtgttgggattacaggcatgagctactgtgcccggccaaaaaaatgcattcttggcagaaatgatggaagtgtagaaggccaaggtttgcatgggcaatgtcaaagggctcaatgcagctggagcgtgagggtgagggagcttgtaagaaggagagggagttggagagaaaggatctaaccagactctggggtttgttaaggatggtaaaacaaaagccaccatttaccactgctctgctgtttattctttttggtaaccctaaaagtcacaaattactgggcccattttacagatgatggaatggagccttgaagaagtgaagtgtgtcaatcatagctcactgcaatctcgaactcctgggctcaaacaatcctcctgcctcagcctcccaagtagctaggactgactacaggcagatgccgccacaccaggctttttttttttttttgtagaaatgggggtctcaatatgttgctcaggctggactcaaactcctggcctcaagtgatccattcgccttggcctcccaatgtgctgagattacaggcatgagccactgtgcctggcaagactttgtgatagttgcacaactccctccctcccaagatgtttttgcactattctttagggtaggagccaggaagtcaggaagtctctgtcttcattcctctgctcttctcacctcctttttcaataacccatcagaatctgccagccagcccctatatctctgttgagaaaaaagtggactcatcagagttgaaaaaattaaggtcccctcctggagtgaaattaagacccactcgagggtcttaccaaactgagcccttgtggaagcgcccagagagctgctgcatttcctcactccaggaggcaccatttacattagtagcttggtacctcctgtaattatacagtgcacagcctgggcagctgcgccaggcagccttggggcctggatccacagctgcttctcatgttcactttcaggctgtggacatgctacttcctttcaggaagaagaggattctggacttctgacaaagtctctcaggcccagggagttgtgtctgagagtgaggctaactgagtagcccaggcttctcaggatcaacaacctggagttaccagagaatcccatccaacatcctgctgggcacagctcagtgtggactctgctggtgacctccctgtcccccacctcttgctgtttggcctgaccttggatctcctctttcaccccagacccctggacctttgggatttttgcattctctagagacttgaggttcctcaaaagtgcctccatgcataccggtgaggtgggctggggatggtaaactctgttcttgtaaggtttacattttgaatttctaaaaattttgtccaaagggattcatttcctagcttttatttatttttaatgcagtttgaaacttactgtcctagattaatctagccttaattctacccgaccctgcctgacaactgggttgcctggcagcatggtggagggacagggaagctgagatccaagcagatttctcctggagtcagattgcagcaggaggtttgggtgaggaaaggctggacagggcgtgaactcgcggggctgttggcatccaaaacggatgttcctgcccccaagcctgatcctggtcacagggttcccacctgaacagtcacaatagccccaaaactggtttccctgtgtcctcttcccccactataatccatttgccaaagagccgccagagggacttttcaaaaattcacagcggatcaagtcactcccctgcctctaaccctccaacacaggggttcccaccccctggggccacggactggtaccagtctgtggcctgttaggaaccgggccacacatcaggaggtgggccctgttgtgaactgcgcatgtgagggatctaggttgcacgctccttacgagaatctaatgcctgatgatcagaggtggaacagtttcgtcttgaaaccatcccctacaaaccctggtccatggaaaaaccgtcttctatgaaaccagtccctggtgccaaaaaggttggggactggtggtgtaacagcttccaattatttttagcataaagtaaaactcctggccgggtgcagtggctcatgcctaaagtcccagcactttggcagatcgaggtgggaggatcactttggtcaggagtttgagaccagcctggccaacatggcgaaacactgtctgtactaaacatataaaaattagctgggtatggtggcgcatgcctgtaatcccagctactcaaaaggctgaggcacaagaatcgcttgaacccgggaggtggaggctgtagtgagctgagatcatgccattgcacatcagcctgagtgaccgagtgagactgtgtttccaaaaaaacaaacaaaaacaaaaccaaaagctcaccacagcctcccagcccctgcacgtcctgcccctacccactttctgatgtaatctcatgccatgctctccgcatggtttacggaaggcctccacagcactgcttctttctgttccttaaacatacccatccctcccactgccgggcctttgcacaggctggtcttccttcctggaatgctcttcctcctccaggtctcagctcgcatgagggaggccttccctcaccacctcagctgaggctgatggtccccgccctgtaattctctagcacatcacctgatttctcgcttttacagcacttatccaagtgtatgattagcttgtttatgtgtttataaacatcgtctgcctccatctccagattacaggctccagagtattgggaccctgtcacgggttcaccactgcattccagctcctgtaacagtgctctaggtggacacttgatacatcattgctaaatggatggataaatgaataaatgaatgaatacatgatgaattgaggaactgaccacagagagatgaaaggcacacccagagggtcccccagggctgaaatgtggaaagaggaaggtcctctttggaaggacagtggccccactctctgggcctaagagagggatctctctctctgggagtacgagagggatctctctcaaagccagcctctgtcaactcccaggacccaggcaacgccatctcctgcagctgggatggtgtctcgctgacctgtgcgtgccattgcacattctcaacagctatgactcaccacaggaaaactgtcaggggagcctgcagcatgctgctttgaaggagccccaacgaatgacagtaataatggtggtcgtttttgaaacgactgcactgagttggtttacttattaagaacctagtctctggagccaaactcccaggttcacagcctgagaccaacactttgtagctatgtgaccttgggtgagttccttaacccctaggtgcctcagtttttttcacacgtaaaatcggaataataatagtacccatcttatggggcagatgaaagcaactaagtgacaaagtattaggcagtttacatagataaccaggtttcatatgagtattattacaaagtattatgtatttattgagcatttacatggtttgggaacagtgctgggtatttcattacctcatttaatcctcacaatgaccttgaaaggggttcataattgtctccattttacagatcagtagactgaagctcagagagctgaactgaattatccatccaagttactgccccaagttatccatccaactagcaaagggtatagtcagaccacgaacctgcctgtcgcccttccaaattcttttcaacacatcaactgtgtctttaaaagagaggtttccagagtcctcctacctgagcaagactaggctgtttggagcatttcttcccaccttcctggcagggcacacccagccctggtcccgcctccccggttaggagctggctggctggctggaattcgtgtctgggcagcatttcaggcagccacactcattttgctttcaatgcacacgcctgggaactgagccaaactgcagagagggcatcatcggccggggtgggaggttggatttatcaacagcttccttctgctccccggatgtgcccgcaccgcaccagtccttagaaaatcctcctgccccaggtctgagtagaggcatctggaggccgggcccgctgcttctgtgcgccacctcgagggcatttcagttactgcatcagcgagcatgctctgcaaatggcaaatcattctgatagccaggtaaaaggacaactgagaacagtcaactttctcccctgtcaacatggtatcctccgtggtctgcttcctggtactccagctacagttcccagagcatcgtgctcactcccacttccacacctttgggtgtgccatttctttctgcttgaaatgactctcctgactcgcctcccaaactcctcctattgactttccattctcagctcaaatactttctcttccacgaagcctcctttgacttttatagtcatattgagacatgcttcctatgttcccacggtgttttatacctacccctttctaaaaacatgcattttggtgtctgcctctgcactcatggttagccctaagaagggagaggtgatgagtttcaacctttgcctggccttacaggtcaaaaatgggtgagctacaaatatgttttgtctccctattgtgtcttagaaaaatgtgaatatgttgctgatactgaaaactgggagttttggccaggcgcggtggctcacacctgtaatcccagcactttgggtggttgaggcaggaggatttcttgagcccaggagttcgagaccagcctgggcaacaaagtgagactctgtctctacaaaaaaaaaattttttttaagttagctgggtgtggtggtgtgcacctgtggtcctagctacacgggaggctggagcaggaggattgcttgagcccaggaggttgaggctgcagtgagccctgtttataccactgcactccagcctgggtgagatcctgtctcagaaaaggtggtgtcggggagttccatatgaaaatctaggtgtctggcttttctttaaaaaattggaagacatggcaccctggacctgcatttccccaaagcaacaatcagctgcagtggggtagtggctgcccccttcagacaggcacatactttctagtttgccatgatctccactagtcaccccgtgtatgcatgtgctcttgatccccagagaatgttgaatttgcaaggaagtgctcaatagatgtgcttgccaaatcaatgaatggatgaaagaacggaagagaaaaatgaaatagagaagtaaatcatgcaggaaacagtctgggtaggagacaaattaatgagatttgctgcctggcacggtggctcacacctgtaataccagcactttggggggccgaagagggtggatcacaaggtcaagagatcgagaccatcctggccaacatggtaaaaccccgtctctactaaaaatacaaaaaattaggtgggcatggtggcacatgcctgtagtcccagctactttggaggctgaggcaggagaatcacttgaatccgggagatggaagttgcactgagccgagatcgtgccactgcactccagcctggcaacagagcgagacttcatctcaaaaaaaaaaaaaaattaatgagacttccttgtgtcccttttggtttcctaccctcagtactgaaccagcaggaaatggcacagcttctggaaggacaaacagattctgtttgactgaccttcagagaaagaatgcattaggggagggagccaggagatttcaagaccatgaagacaaagtcaggagaggagtctggaggctcaaatccttacatgaatgtcgagtgttttgattacagcatcaaacctagaatgtcattagtgaccagtgtttcatctggggataggatgacgcttcattatccaggaaagtccttcactctccggggcacttggcatctctggttcctgccacgaaatgtcaggagtatccccctccttctcaccttacccctactttggcccaagtcatagtgacaaccataaacgcctccacacatttctaaatgacccctgctgagatccactggtctagaaccaggatgacactggaaccaccatttctaggcctgacccacatcagacattgctaattgactacagaactttttctacagcctcagactccctctccaatcagcactccagatagcttccatgcatcagctggagctggctgccatgttggaggtgtgcaatacagcctaggcccgttgaatcttcataaaaccttaaacaacctaatttttgtgtctctaattttctttccaatggcaatcttactgatacattaggcttaaaataattctgcagctctcacacctactctcccagaggccaacacccttatcatcccaccaaggtgccccaaaacccaatgtggcccatggaccctaatcgttctccttgatctgctgcttggccacttcctggcctggcctgctctccttggccctgtttctcctgctctgacctctgaccactctcttggaccacacttcacacccactcctttatccacaatctttccttggtgccctcatccaggttcttcagatgtcagttacacactaatgactctacaatttttgttttgttttgttttgttgtgttgtgttttgttttgttttgagatggagtctcgttccatcccccagactggagtgcaatggcgcaatctcagctcatggcaacctccgcctcccgggttcaagtgattcttttgcctcagcctcctgccaccacgcccactaactgttgtatttttagtgcagacggggttttgccatgttggccaggctggtctcgaactcctggcttcaagtgatctgcccgcctcggcctcctaaagtgctgggattaccggcatgagccaccgcacctggccttgactctgcaatttatatttccagctgagactttcttcctgagttgtagcctcatataatccaactgcatatttgacttctccaactgaatgactaacacacgcctcaaatccaacacatcgagacctgaactctggattttccaccccaagcctgatttgcataagcacagtcttccccatgccaattcatggcaactccatccttgcagatgctcaagtgaaaaatcttggactcatccctgactcctctgtttctctcattcctcacatccaatctgtcaggaagttctgtcagctttcctgtcaagatatatccggaaaccaccccttcaccccacttccaccattacctccctgatccaagccaccatgatatcttgcctgaattaccgcaacagcctcctggctggtgttgctgttccttcattcctggcacagcagccagagccatcctgataaatttggtgacatcattcccgccctcagtaccctccaatagctccagctttactcattcccccaaccctccccttcgcttaaactgctccagccctcagccacttcactgttccttgactctgccaggcacacccccacctcagggcacttggcttggaatgaccccagtatctgcttggctaaatccctctttcaagcttttgcctaacgatcacttcctcgatgaggacttttctgacaactccatgaatatccttccccgatcctcttccctctcctcttttgatttccacaggacttgtcaccttctgaactttacctgtctccccctacttagaataaaggcccccatcactgcagggatttttgtctcttttgtgcatgtctgtatccctggcacctaggatagttcttgacacataataggccctcaataaatatttgatgactaaatgacttgatgatttatgctaattttgggtagacatcctagccagttcagcccaaatccagagagagcccattccaggtataggctttctttctttttctttcttttcttttcttttttgttttgttttgtttgttttgtttttgagatggggtctcactctgttgcccaggttggattgcagtggcgcgatctcggctcactgcaacctctgcctcctgggttcaagcgattctcctgcctcagcctcccgagtagctgggattacaggtgcccaccaccatgcctggctaatttttgtatttttagtagaggcggggttttgccatgttggccaggctggtctcaaactcctgacctcaagtgatccgcctgcctcggccttccaaagtgctgggattacaggcatgagccactgtgcccagcctaggtatcggctttcaagacctctgtccccactgggttcaatcggaccttgagactggtcccctgacagtgatggggcaacagcaaccagtcagccaccccagggaaggagccacacccctgattcgggggcacacttgctaaatggatggatgaatgaataaatgaatgaatacatgatgaattgaagaattgaccacagagagatcaaaggcacatccagagggtcccccagggctgaaatgtggaaagactgtgtgggtcttagaatacgggggcaacataatgtaggaggtttcttccttccctcctttcctctgccttgggcttcctccataaaaacagagaaggggacacaggctgaataggacactgggatggagaaagctgtggtttcctttacctttccaccgatggtctttttggagaggaggaggcagaagacttggagtccacagagtctctcctgaaagaagaaaattggcaaggagactgctttgtagactagcatcagtactgacaggaaggtggggagaaagcatcctgggaaaaggccagctggcttgaggctaaggaagcccacccgggccacagctacttgggagagggagctccaggcggtgccggctggtcatgaccttcacctaccctccatcaagtgaaccaatacaagggaaggaagtcgatatctgccaagggcctaacacatgccatgtatgtgacatgggttgtgttgctcattatttacaactattctcagcaggtccctgtcctcctggctgtcaggcaggccttagctaactggagtccacagagactggattcctggagttgtctgtactcatctggaaccagagaaacagagaaatcagcttcagcctccccggcaggcactttaggaggaggagaggagaaacacatgggccttggggatagaagagctgagttaaaatagcaatcaaaaaagcaggagacaaaattagatgcggactgtgcctaaagtcacgcaagaaaaccaatgcataggaggaaaagcagatctaaagaaaatatactcaaatgctaaccactgttacagctagggtgatgggattaaaggtgattttttcccaatttttccaaaatgcattcagctacattatttttatgatatataatatagttattccttttactggttttaaaaaatcaatctgtttgttaattgcaaaccccactccccatctcacttaccctgccttccttttaattccatagcacgtgtcaccttctagcatactacataattgactttttttctttgagacagagtctcactctgtcacccaggctggagtgcagtggtgctatctcggcggctcactgcgacctccacctcctgggttcaagtgactctcctgcctcagcctcctgggtagctgggacttacaggcgtgtgccaccatgcctagctaatttttatattcttagtagagagggggtttcaccatgttggccaggctggtctcaaactcctgacatcaggtgatctgcccacctcggcctcccaaagtgttgggattacaggtgtgagccactgtgtctggccaatttacttatttatatttaattatatttattgtccgacaccccatgtaaattccacaagagcagcatttggtgggttttggtcactgtggtgaacattgtctgtgctcagcccagtttcccttgggtgctcactctctcagtgcctctggacccaagagctgcctcctgcaagctccccagggcctctgtctgagggagttcttccccacagctaggctggctggaagtgctggtcactaattaatgaccccaggaacagccctccaccagacacatgggagaggggaagagaggtcctcattcacatgcccctgcactcccacaacaggccctgggagttcttctgtggggcttctccctagtgcaccttggggatagacaatgcaagcaggaaccataagctggaattcctacagtgggagaggggagagaagacacgagactccaccctggagaaccactttctgactcttcctcattgcttttctttttagaataaatcagaaatactccgcagttattgcaaatgactgttatgaaaactgttcaggaacataaaaaaatgcttagaatacaatagcaagataaataaaaaggtgacatattagtcgatactagagctagagcatcaggaaaagtctaaagattagaccgtaagaaaatagaaaccagctgggcgcagtggctcacacctgtaatcccagcactttgggaggccaaagtgggcagatcacttgagtcaggagttcaaaaccagcctggccaacatggtgaaaccccatctctactaaaaatacaaaaattagccgggcatggtggtgtgcacgtgtaatcccagctactcggaggctgaggcagaggaatcacttgaacctgggagatggtggttccagtgagctgagattgtgccactgcactccagcctaggcaacagagggagactccatctcaaaagaaaagaaaagaaagaaaatagaaaccatgtttcaaagacctgtattacaggtacttcatcagtttgtaaggcatgagtccaaaacagctagcagtttggttcttgaaagatccctgaattgtatgcagttacttggacaagtgggttaggaccttatcatgagacagatggaaggaaatactccagcacaatattttctctagcaacaaatgagatgtggtgatcaggggacaggaaagtgtaccaaatgggtgatgtctgtcaagatgacatggcacagaatatcagcattctagccaggccctggagatgtggcacatcagtgaaaaaggggtctggaatttatgtttatttttatttatttattttgagatggagtctcaatctgtcacccaggctggagtgcaggggcaccatcttggctcactgcaacctccatcccctgggttcaagagattcccatgcctcagcctcccgagtagctgggattacaggcacgcgccaccattcccggctaattttttgtatttttagtagagatggggttttgccatgttggccaggctggtctcgaacttctgacctcaagtgatctgcctgccttggcctcccaaagtgctgggattacaagcatgagtcactgcacccagccagaggtctcgaatttatgcagaagaaaaagtagactatggtgaatacacggataaaaataatgggaggcgacaagcaacaacaatcatagtgaggcagaaatttaaaaataaatatgcattcattcaccccaagaaaagtaacaggcaaggcaagggttaaaaagaaaagaacaggttttcctctgcctagcaagctcacttcaaggacagttataagataatgctgtttgggaaaccaaggccaaaggaatgggctccagacacccctcccctccagagcaaggttgaaggaaaaaaagagagaaagacaaattcctttactattactcctttccctgacttcttaagcatgactatgttttacaaatgtctgtatttagccagttcttgtttttctttcaatgcagctacaaggctgccagctatgcaaggccacaagttatgctatgctatagattatgtgacctatcatatgattaactgcttttgttttgcttctgtaagcctgcttgtaaaaaccccgctctgtctttgctaaaatgctcagctgtttagatacgaatccactgagccggtgcataccttaaataaacaaccctcctgctctcctattggtctctctggtcctcagtttcctgcaatgatagctgatagtaggatatttctgagtgaccagacaaaggagaaggcatagaatgggtgattcttcttcggccattgtttgctacagtctcatttccaaatcacgtataatctttatagttcctaaggacaaaaattcaaatactgttttatatttaaaaaaataatttgcacccatagtcccagctactcaggaggctgaggtgagaggatcacttgagcctaggagttgcaggctgcagtgagctgtgattgcgccactgcactccagcctgggcaacatggtgagactctgtctcaaaaaaaaaaaaaaaaaaaatggccgggcatggtggctcacacctgtaatcccagcactttgggaggctgaggtgggcggatcacttgaggtcaggagttcgagaccagcctgagcaacatggagaaaccccttctctactaaaaaaaaaatacaaaaattagctgggcatggaggcacatgcctgtaatcccagctactcgggaggctgaggcagaagaatcacttgaacctgggaggcggaggttgctgtgagctgagatcgtgccattgcactccagcctgggcaacaagagtgaaactccatctcaaaaaaaaaaaaattgtacagtctgcctaaaggaatggaaaaattatgtatgtagttaaaccaggcctgggagaggagaggaagaaaaataaaagctgcttaatttgtctgatgtgcacaaatatttcccatgcttattctaagtttcactaatgtggttacagtgtttgtataatgaattatcattaagaaaactaaaaaggaaggaaattaattaactgagctgaaataggacccccgacaactggcttctcccagcagaatgaggagatacctctccattttctgctcagcaccagcgacagcttcatttctgagccccatggctgtgaaaagtgagtgggcataacaatttagtgtcccaggaaaatgtatagtgcatttcaaattttattaacaaaatataaatataaatgtacatatgaatgttctttttttctttttttttagactgagtctcactcctcacccaggctggagtgcagtagtgcgatctcggctcactgcaacctcctcctcccaggctcaagtgatcctcccacctcagcctcccaagtggctgagaacacaggtgcacgccaccacgcccggctaatttttttttacttttaatagagatagggtttcgccattggtctctaactcctgagctcaagtaatccacctgcctccacctcccaaagtgctgggattacaagcatgagccactttgcccagcccatatgtatgttctttttgttttaaagacagaatctcgctctgtcatccaggctggagtgcagtggggtgatcttggctcactgcaacctcagcctcccaaattcaagcgatcctcctgcctcagcctcccaagtagctgggattacaggtacccactaccatgcccagctaatatttgtatttttagtagagacagggtttcaccatgtaggccaggctggtcttgaactcctgacctcaagtgatctgcccgccttggcctcccaaagtgctgggattaagggcgtgagccactgagcctggcctggcctgtatgttcttaaaaaactacaaagatatacattaaaatgttaacaatggttatttctgttattttcttcttgtgcttgattttctaaactttttacactaaacacaccttgctactgaaatgaatacatttatgtacatgaaaaggttacaaaatagtatacagagtgtaattcaattttattaaaacaaataggtattttatacctatttataggtagtaatgcataggaatagtctagcaggatgtatatatatatatatatatatataaattttatatgtatatatacacacaattatatgtgagtgcttgtttctagataataaatgatattttattttactttattttattttattttttgagacagagtctcattctgtagcacaggctggcgtgcagtggcacgctctcagctcactgaaacctccgcctcctgggtcccggttcaaacaattctcctcctcagcctcccaagtagctggaattacaggcatgtaccaccatgcccagctaatttttgtatatttggtagagatggggtttcaccatgttggccaggctggtctcgaactcctgacctcatgatctgcccgcctcagcctcccaaagtgctaggattataggcatgagccaccgtgcctggcccttatcttttgttttgttttgttttgtttttaagacggagtctagttctgtcgcccaggctggagtgcagtggcacgatcttggctcactgacacttctgcctcctgggttcaagtgatttcctgcctcagtctcctgagtagctgggattacggggcacccgccaacaggcccagctaatttttgtatttttagtagagacagggtttcactgggttggccaggcttgtcttgaactcctgaccttgtgatccacctgcctcagcctcccaaagtgctgaaattacaagcatgagacactgcacccggcctattttcttatttatttgtatttttaaaactttctacaatgagcaagtaattatctgtattataaaaaatacaaaatcgctaaactaagacaactaaaatataattaaagactattacaaataaaacattttatttttaagaagaaagaacggagaaaatgatgtctgtgtttcaggccataatactgagtctcagagaagaaggccataagtgacaagttcagcccagaacctggctttctgctttttcattgttacctctcctacacctgttgttctcatacaggcctttaaaagaaatccctttactgttcttttttttttttttttttttttttttttaaacagagtctcactctgttgtccacgcttgagtgcagtggcgggatctcagctcactgcaacctctgctcccgggttcaagtgattctcccgcctcagcctcctgagtggctgggactacaggcgtgcaccactacccctggttaatttttgtatttttagtagagacggggtttcaccatcttggccaggctggtctcgaactcctgacctcaggtgatccacccacctcggcctcccaaagcgctgggattacaggcatgggccactgcgcccagcctctttactgttcattcagtggggcttggggatggagcaaacaaaaacaaaaactgcatgtgttcaggctgccacttttacctggatgcctacactccccatgtgacagattagtcccaaatcccatttggtccctccccagtagttcagcctctagtccttcaacttcatctcataagagctctcctgctcctggtccttcatttgccaaggttctcataaccacacaggtgctccagacatggccagaccagccagggcatgaacaggaggtaatccacagggcaggggaccatgctgctacaaatgggctagcagtattcagtaaatgttcactccgtgctaggcactgtggagatggtcagggattccccgagccaaacttctaacccctttgggaaaagaaaacacactcgtgtgaaaagttagatgccaattagggtttttccaagtaggatacacttgcaaaatgagcaatggaaaggaacagaacatagaaaatgtgacaaaaccatttcacaggcattaccttttaaaaagcaggctattaaaattggggatgactatagaaaacaagtcagagaacagaaagaaaagccatacactaactcatcaagagtgattgtctttgggtggtgggaatgtgggtgatttttttttctacttttctacattttcctttttttttttttttttttttgtgagacggagtttcgctcttattgcccaggctggagtgcaatggtgcaatcttggctcactgcaacctccgacttccaggttcaagtgattctcctgcctcagcctcccgagtagctgggattacaggcatgtgccaccacacccagctaattttgtatttttagtagagatgggatttctccatgttggtcaggctggtctcgaactcccaacctcaagtgatccgcccacctcggcctcccaaagtgctgggattacaggggtgagataccgtacccggccttccattattttctacaacagatttttatcactcttatttgtttagtttttaaaagcactattattattttttgtttcaaaagcagtacaggatcattgtgaaaaaacccaacaattcagatttaaaatttttattgtataatacagaaagtagagatccttttaatttataatatatgtcttggtttttgtttgtttgtttttgagacaggttcttgctctgttgctcaggctggagtgcagtggcgcaatctcagctcactgcaacctccatctcccgggcacaagcgattctcccacctcagcctccagagtagttaggattacaggtgtgcgctaccatgcctggctaatttttgtattttttgtagaggcggagttttgccatgttgcccaggcttgtctcaaactcgtgggctcaagtgatcctcccgcctcagcctcccaaagtgctgggattacatgtgtgagccactgcgccaggtgcaatgaatcttataagtggctattgcctttgctagcatcttggaatctttgtctttgggactgttacaagattcgggatgtgaggcttatacccgctgtggtcttgtttccccgcacctaggctgttgcctgggtgggccagagaagagctctagactgccgtgcggtctcctatgggaactctctgtagagaaatgctggaggccctcccgcagacgcactctttcctgtccctgcatccttctaggcaaagccagtgccatttatgtcctatttgggtcttgtgagtctaacatctggttgagccaaagaagacccccagagggggcactgcaggagataataccaatatcttcctccccaggatgaaaggtttaaatgagataatatacactgagttgctgtcagaggacgtgacaagtgtcagctcccttctctccatcccaaaaaagaatacctggttttggggtcttctcgttttttccttggtggagaaaggcctgcttctggcttccagtctgaacactcaagccctttttccttcttctttgccttttctctttcctctcctttttctccttttgggggtccaggggagtctgaaaacaaaagggtggcattgtccctcagctaagctctgtctcagcagaacccagcatgacttagtggggagagagcaaagggcagggacgaggacagctgcacacacactcccaacacacacacaaacacatttacacacaaatgcacaaacaacaggaacgtgtgtacaaatacacagtctcacatggggacattaatacattggcaaacacatctctgcacatattaagacaaatgtgtgcatgtagacatgtactatatagacaaatgcatgagagcacaaacacgtaagtggcacatgtacacaaaactcacaagtctacaaatcttgcacttgtgtacacaaacattggcagtcccccactagctacctcccggatccagaggccatctgtcactgattaagtcactcaacagacatacactgagtgctggctatgagccaggcccagtcctgtcccaagtgctaggagaaaaacagggctcaagacaaccttgtcctctctcacctagcagccgcttccagtttttgataaggactttggccaaggacaccacctccttgtctgagcagtgcttgcggaccccattaacagcaactccaatcctggttgtctgcaaagtgagagggttaaggcataatctgggaatggatacacaggaatggctgccatcattggcagatcctgccccagctctaccaccacctccccttccaacctggacccccagagtcctagccctgactcctggctgaggtcagaaccccactactgtaactaaggccctgctctgcacgaggccgagggcccagggctaagcctgacatggaggatatctgtagctttggtgaaacctgaacctagggttgggggtggcacttggctgactgtcaggacccctcccattcccaaccctctagtgtctatttttttgagatggagtctcgctatgttgcccaggctggagtgcagtggtgcaatctcagctcactgcaacctccacctcccaggttcaagcgattctcgtgcctcagcctcctgagtagctgggattataggtgtgcatcatcgtgcccagctaatttttgtatctttagtagaaacggggtttcaccatgttggccaggctggtctcgaactcctgacctcaggtgatctgcctgcctcggcctcccaaagtgatgggattacaggtatgagccaccgtggccagctcactctagtgtctttgagctccagtttcaactgagacagcagctccggctatgagaccttgcatctgtctgtgctgatttttcagggccaggagcttttggtaaatctggggactttaagggctacacagggattttaaatgggggcttttccctctccctggatcattggcctcttggatcccacaggcccagggccttgggaattggggtattcaagaaaagcgaaccagtcttgctccaaggcccagaggtcccctacacctagaagataccctctccgcccccgagatgcccctgtgtccccctcagtccctccctgggaggtctccacctcaagatcccctccccacaggcccccctcagaaattcctcccagactccaccttcccccaccaggggtctttccctcccccaccagctctccccccaggcactgtcccaaggcttcccacccccgccccacctgtagtagctggatggacatctggcagctgtgcagcttcttcagaaggtccagggccccttcctgtgggaggccacaaggtgaggactggggcctgggtcctgaccaggcttctctgactattgtgtggtcttggtacagagagcaggaggatacagacagacatgtggccgaaggacaggcaaggggcagaaggaaggagagagacgagaaacaatctgtcctaggtggtgctctaacttcatcccccgccacctgctgggttcaaaccctctgagccaggctcctgacctccagcctttggttctgctgtgcctctccccaggaatgccctcccccttccccatctttcctcccaaatgaattccttcctggcttattgttgctcgtgtgcctgtagcgtccttcccttacctccccactgtgaacttcgcagggtgaggactgggagccttttaaaaaacaaaacagaacagtttggccagcatggtggctcacacctataattccggcactttgggaggctgaggtgggcgggtcacttgaggccaggagttcaagaccagcctggccaacatggtgaagccccatctctattaaaatacaaaaattagccaggcgtggtggcgcatgcctgtaatcccagttactcaggaggctgaggcaggaaaatcgcttgagcccaggagatggaggttacagtgagccaagatcacaccactgcactccagcctgggtgacagagcgagactccaactcgaacaaaacaaaacaaacaaaaaacagcttttttgaggtataattcacatacaataactgcacactttgcagtgtaaaatttgataagtttcaacatacgtgtacacccatggaaccctcaccacaatcaagataaaagcacagccaccagccccaaaagcttcttcctgtcccctttctaatccatccctccccatccccaatcctaaacaaccacaattctgccttctgttactatagttgaccttgtatctttaaggattttatgtaaagagtatgtagggcaaaaacccttttttatctggcttatttcggcataatgattttggagactcatccatgttgtctcgtggatcagtagttcctttttattactgagtggtttccactgtatgtatgtaccacagtttgcctggcattttttgagacaagatctcactctgttgcccaggctggagcgcagtggcacaatcacagttcactgcagcttcgactttccaggctcaggtgatcctcccacctcagcctcccgaatagctgggaccacaggtatgcaccaccacatctggctaattttttgcattgtttcgtagagatagggttttgccatgttgcccaagctggtctcaaacttctggcctcaagtgatcctcctgcctcggcctcccaaagtgctgggattacaggcgtgagccaccacacccagtctaccacaatgttttaaattcattcaccggttgatgggacttatggataggttccagtttggggctgctagaaataaagcttctaggtacattcatttcaagtctttgtgtgaacaggtactttaacttctctcgggtaaagagaaccgttctaatctctgagaacttagggctcagcagagagtccagtgctccctgagtggatgaacttgtgcagaactaaagcagaaagaaggcaggaggcagaaaaaggcttaggtttgaaaatctgtgagctgccaggccctggacaccctccgacccatttcagccttctcctttcccccagccccttcctagaagccatacctgcctgctgtcctgagatcagttccctggggagcaccaggggacggtgtcctgtatgttcctatccttggcccacagttcatggttccagctgccaatccccaccctggcaggacctggaccatgtcctaagagctgccctctgtcagtccttagcctccctgagaacttgggttcacagtaggttttcagaagcgtgacctgcagatgtgtgtgtatgtgaacttgggggtacacaactccaagtgtaacattaattaaaggcttgctatgtactaggcactcttctaagttttttacctgtattatctcatttaacattcacaatggccctatcgggtaggtcctgtgtattattcccattcttacagaattattatcctgtgttcaccaaagagcaatccaagaaagagagaggttaaataattttctcaaggtcacatgctttataaggagccaagttgggattcaaactcagtccttttgggctctaaccactatacaaattgtgttagcatgggcgcagatctgtctagacatacacaatcatggaatatcaacatgggtaagtgcagtggtgtgctggccaacgtttaacaaccagttctcaaggaaaaaaaaaaaactgacctgtagtgtttgccaatttctgtggtgtaaacactcatcccatggccaatttcaagctaccaacatgctgtcactgaactgaaggaagttttgggaggagacgtacactaccataccattatataatatttccactgtacagataacaatagaagtaaattatctctgaccatacatgacagtacaatgtagtaaaacaatcaggaagtgattattttggaggattccttacctttgtttttaatataatttatttattgtaagcagataatgtagttttttgaaacaattgctgtgtttaaccaccaggttgcaaaattcctgaaaacgcaacaatctgtgttaagccagttccagctctccactgggtgtatgcctcgtgtgtcacagctgtataactgggtcatattggaggagaatagccatgagcctggattgtagctggataaacaaagccttgtgcaaatgttgctgggtgtatctctctgaacatacaaatgggttctgtagccagtagtatctctggtctaagtgtgcagctgtgaatatgcagctccgggcacagctgtgtctatttggctttgtgggatgacgcctgtgttataagatctgaatgtataaatgtggctgtttgctaagtctgtagcattgcatgtctgggtgtagctgtgctgcgtgcatacgtgtgtggctgtctttgtgtatcattctataactataatggtcaatgtgggtcatatgggtcagtatgcttgtcatgttggtgtcagtagccgtgtctcatacgcagttaggttcagttgcttgtttaactactgtgttgtggccacatgttatagctatgtgtgtgtatgtagctgtgaccgtaggcacttggttgcatgtttgaagttgcttctgttagtgcatgctcagaggatgtgacaaagccttaagtggctgagacttcagcaaccggcagtaaaccccgggcctgagctgcaacgtggaggatccgtcttattacaggaagtatgtcctcctctgcctaaccactgctgggcgggtccactttcactcccagagcaggccccacctttctcggccagacgcccagagctccatgcccacccagacactgccgagagcccaggcgcagacgtggctgtaaactggctccatgctgcagggaccctgcggccagacttgcatcttttcaggggacagctctgggcacttccacaggaatccatctccaaaagacaccatttcctcttcccatttcacagaagaggaaactcgaggtccagaaagggaaggttgagtggcttttgcctagggccataaaaggagtgagggggaggccagggcaggtcccgtcctcttcagccagagctctatcccaagcagcctgcctctcctccggtctctaggcgtccccaccctacccctcttacccaggggcccagaatttctttcctggcccaagcttgggggtcagtaaggagctgggctgggataacccgtctatttgaactggaatttggctcagaatccctggctgcgctctgccaaccccagctgagaaaatgctcccccaagacttgtggctcagttgtactgaggattgtggaggagtctggaacggggagtgcatggaggttgggagtgtcaggtgagaagctcccagcactctgcaggtttgtgctgtatctttctgtgttggacctggctgcgtagaagcaggtcttgttcgccagttcttagcaagcacaggtctgagtcctactaagggctttacatctctgtctcatctctccaatcctcaccgctgccagcagagacaagaatccagtgacatcccttctccagaggcagataatctcatctctttcttacagatgaagaaactgaggctctggcctttatatggacaccaactcatgactgcccagtgtccactctagggctccctgccacttcatggttccagtgacccttccctgggccttggctactcttcctggctctaaaacttcccttagtgtctcttcctttcccaggctcctaagtgtcctggaaatgcaggtggctgcagcacatggctacggatggtgggaggaagaggaccctggaacaggaacgggaggtgggaagggcatgctcaccaggctccctttttttccctcccagggtgagcgcaggccctccaggacccaaggccaaatttgctctggccaggcgaccagtcggccgccagccccaggcaaagatcacggggaagatcaaacattaacttccagctgggtctgcgctctggccaggaccctccggtagggctgtcagccctgctcccaacctcccgccgagcccgctcctccctccgccctcgccctcgctgcacaggcctccagcccggcccccttcccccgccccgcgggcccccgcacctgttcggcccccgcccgtccgggccgcaccccaaggccaaggaaagggaaaattgccaaaagaaccgctcctgacgcaccaagcggtggggtcgcaggatccacggccttttacttctctcccgcagacccactccggggtgcagggatgcagctcagtacccccgtcagcccaagtttctctgccacttctcgggccacccggatttgccccccgccccgcccccgccatcgccgccgctccccgggctttgcacacgccaagccctgggactcccaaagtcctttcccacgtccagctctcttcgcccgctttcctgggccctgcactagctgcccagggtgaaccctacacgtccaaagggacgtgcacaagtcgcgcctccgggacccgcacgatccccctggcgtcctgggccacgcacacgcccacctcgaggtgctcagcaagggtccccaaggggccttgggccctgcaccagccgctcctccctcgggtccccgagtcccgtacgcgcccccatggcgccccgccagtacgtccccaccccggaatccggggcttgcccgcgcctcccgggggcgggggccgtggcccaaactctgcagcctcaccgtgttcttcctggccaccatcttctccagctttttggcgatcctcagcagctcctcttcctggcccatgttggcccgcgacgcccggcggggcgaggggcacaggggcagcagtagggcctcgggggcaggaggcgcgaaggcggagggcgcgcaacccgcgcgggccccaaacacacacgacacacacgcccggcgggggcg

SEQ ID NO: 498 - DNA, 368558 bp, Homo sapiens
ttccataaaggcagtgtttttttaattttaaaattctgcatctgaaaacacagtatgacagaaagcatctatatacacctgcagtgtttttggtatgatacagtatttaatacatccactgttttctgcaaaaaatgttgctttgtcagacagaaacaaactcccctagacaaaaaaatacagctaaggcacaattttgttgttgttgttgttctgcaaaataaaaagacagaaaaggtgcaaaaaagggcaggtaatgcagtcatttctgagactcacattctacctcaaggaaaagcattcagatgattggaactttgattactggtcaatttcagatagttcaatatctcttaaaatactcctttaaataaatagcaaaatatctacatatttcagcgtgtgccatttgaattctttttttaaaactttatttacagattttttttaaaatcaacacattacaaaatatttctgtacagttttatgcatattatgatctataacaaaatagttatttttaaaaactatatcaccacatgtctttgaaaacaatgaaggggacggtaataacttagagtgaggcctctaaaacaaatacccaaacaaatgctattgacaacataatatttaaaaaaaaaaaaggcaaaaggactacaaagacaattgcgcacaattccagtgaatttcctatgaaaaccctggggttgtctttggcctccatcagcactggagcaatggaagggtaaagaatagagtctgaaggtagggaaagggtgattcctttgagaacactacccatctgctgggaatatttagtgctatcactttccaggcaggaaggacgaagagataaatggagaacgtctcctgatttacccttgaatgaagtacatataaagtcacccagtcttgggggcaggggaggtctgcaaagccttttcaagcactctgccgataattaagccagcccattacagcagcagtatgctctgagagagtgcttcaggagttggctgagctttagatgagcacccaagccttcattttgcccataggaaaaatataagaacatttttcttaaagacgacatttgtaagcaattcctatagcatctgccaactacagattggcagccccttccttaggaggctgccacagaagcttcacgatgctgtcttctctgatgttggtggagatgggagggaaaggatggatggtcagcttcccaaaaataatgttaaggccacatttcaaaaaggagaaacctaaggcttttgttttgttttgttttgtttttgaaggagggatgggagaagcaagttggaggaacatgagggatggagtagatgacgttagggagggggatgacaaggtgcagaacccgctttctggtggtatctgtaggcagaggcagttggaatattcccagccaagtggagagggaagagaggtcactttctccctgcatacgcctggtaagaccagagccaaagacaacgtgaggggtagacacaggtggcgcaagaaagccctcctccatcttaagagggtcctatacagtatcttgtttgcaaggtaaacacaaaacaaaacaaaacaaaacaaaaaaacttctaagagagccagagaggaagagagagaggagagagagaatttgcatagatcatacattcagctcaagcagatttggacaactttgttcccccctcccaggtaaacttctcagcagacacaatgaggtagcgcctgtggtagacccatgggcaaagtaaggtaactgaggcagaagcaaacaggacatcccgtgagccagcacagctctatgtggtttccaaagaggcttccagggatgggacaagatggctgtgtcaacacttgggatttggagagagcctggctgtttcacaccctacctcctcctcctcctagactgtctttgccatttcggcctggtttgatggagtcccacaagctgtagccccaggcagatgtggacctctgcatatctaaggggcagcagtccagatctccagattctattccttcttcccttcagcacaatcttgggaccaggagagctgaatgatccatcccccctctgtggaatggtctcttgaggagtggaatgacttagcaagaggtccccattccgagttcaacatgggctgttatttttgccctgacctgatgctggcttttttcctcttctaccagggcaatgcataatctcactttaaaccacctctccagagagcagaggttgctggcagtgtacacgtggaacagtggaatttttctttgcccactatctgttaaaaaaaacaaaaacaaacaaacaaacaacccgacgttgaaaaatcagattttttccattaaatctggatttccggcttcccttccaaattggaagattccactacactgtgcttacatttttacaaacaatgacaggttggggctgagtagcagctgctcattctgggtaggtcacgtgcatgccagtaagaccacagtccccatccttgcccccaccatgcccttttgcctcacaccaaccatttcacgcatctatgctagtattctgggccccataaacatttgtaacccctaccacagtgtgtggctttgatcctgcaggtctagcttgctgtctttaaagtggagtgtgttaacagctgtttctagaatgtacacctctccacccctagatgtacccctccacctgaatgtacacctctccacccctcgatactgctgggaagctggtgctccaaatcctcagtgaacttggttgtgaaaggactctttattcacaccccactgccagtagctactgccctgctctctgcatctttttggcagaaagcttaaggttctagccagtgtcttctgtgttatctgcaaactagagaaccagagggaaacatggtcttcagacaccctacttgtgcccagagtagaagcaattgcagtgagtgagagatgggggcaggtcctgtggttctgctcatcctctctaaactccatttgcgttttagaagttaaacccacaatgagaaatgaagccggaaggactcatgatctcaccaggaaagccttttttttcccctgcaaagggagaaagcagcgcgcttctcacaacacggggaccttgggaattgctcactgcctccttggagacacactgctttacgtgtggaccgggaagtgaagtgggatgtgggaaggctggctgtctcctgagctcaatttctgcctgaatgtcactcggtgggtgggaaactataaggagtgccgcagcctaaagaatgcttccttctccacaaaccaataccccaaggcccacctgtcagccttcctgagtttccagggacctcgtcactggctcagctcacagctgcaggctgtaataggtttccagagaccacagccctatgcttttgaaatcttccacagcccaagctccaggctgtctgaccaatggcctccaacaaataaataaatcattctcaggcaggttaaaaaaattattttccctgggaaaacatcctcttttctcaaatcatgctgggctttgtttgggattttccttaaaaaaaaaaacaaaacacaaaaacacaacaaatgtaatatctgcaaccttattctctggtctattaattaataacatcagagaagggagaggaataccctgtgtgacttctcagctccccgaattagttgtggtgaggaagaaatgaagccatgggaaaaagggaagggtccccagagtcagccagctctgccatttctccacttgttccaggataaaaacaaaaaaaggcagacatgttagtgggtgcaggaggggccccatcttgaagtctgcaggttcacattatgcacagggacttgccactgctgagtccccaaagccactgcaaataacgctgcgaacacaaagcactggtggcccagcaaggagggtgaaagggaagctcccaaagtggcttcggcagccccagggaaaccctggccagaggcagaggccgggggcagaaagaggatgtggcacccagcgcgtggccaccatagagtctgtaaaagagatcataggggctttctgagaaaagtaccctgagatccctggaatcgctgttgagaatggctatctcccggactctgctgcctggatctgacgaccctcctcctaagatggatctctctcaaaggagcctgtttccctctgttaaggtcgcatgaatgcccataattagatgggccatgggaaggcaaccacggagcaagcaggaatggcccaaactctctgcagctagcacattccccacaaactctctgcagctagcacattccccactcaccctccacgttttctgcctgtcacctccttgtgcctgtgacggggggtgagtagggggaggatgggaggctcaggaattccaatactcttggaatccgagggagagtgaggctgacactctgcataaggaaaaaaacaaggctccaacggtccccaaggcaccccactcaaagccagtggaagatgcgggttggagctttctttgcgtggtgttcgatgcccctgctttactctgaggatgaggaggatggggggtagacgcagagaaagagaaaccgagagagagagagacaccagggggtgggaaaagatgggaaaaggggccttttgtgaataaaggcagcttcagttagtaaggtaacataattgacaagctgcaaaaacagcacctactaattagtcatcgactaaaacatgtaaataataaatatctaaagtgtcccttctctacgtcctccattgccaacaggacaccctgccttgcgaggcttgggatggggcaacacatctggctaggattaggacaagtcacacaaagcgaagggcagccccttcaaacccacgctggagagaagtgtcaggactggctctccatgggaagggcagatggctaccaggggtgagacctttttccaagggaatcccatcattcaggggaggtgggattacaggagcaagggaggcctcctgcgaagagctctcctggtgaacagggatgacactccagggggctcgtggcaaggaaaccttttgggtttctggtaactcaacacttaaatcatactgttttttgttgtttaaataaccttcccatttttatgttgcatgtcccgttgagcctgtggccgaagggcatgaaattaaaaaccaaatctgaaatgctatttcctggacgggaaaagtctggttcatgtggtttggtcactcccaacagcaccggtgtgcaattgacgaaggttttgtgtgtctgacctcagaacggaagggctctggcaggggatgggtgctgctgtgctgtctagctcaggagttttgctccaagcattgctttgtgagtttcatcgcgttgccttgtgagtttcatggtcatggctgtcaaagttcccattttcaaggatcaaagaaggtcatggtcttgagtctggtgctcacaaacatcatcctatttctgctactttgtgtggcagccttgagggaaggaggcccagacccctggacaggtggcagttgcacttgtggctggaccttggccatgccacatcaaaaggctttcccacttacctagttactaaggagaatagttcaacccaaggagggctgctgagaggctcagagctctcctaaggctgcagcctccatgggaaagggcccacgaccatgactttcaaggctggcaccagagtcccccagccaagagaagcagaaaaatgaaccaaagggcagggctggagtttgaacccatggttggtctgggcagtgcttgtcaaactggcatttgcagagcccttgggttctgaagaggtaccgtaggagataccctgggcaaggggaccgcccagagggctgagctttgggagggaacctcgcacttgtcagcttcaaccagagcagcttggatttcgtcagcaccctgaacctccacttatgactgtgctccgtaaacgaagttctgctgctcgaaagaaaagtctgaaaatcacacgtctggggtcaggggtgggtcactggaaggggaagacaaggaacctgtaggacttgaggatcaaccagaagaggtgagacagtcacagtgcagggactgagccatcccacccgcagcttgccaaaggcaggttgttggctgatcctgctttgacctgctgaccttccctttccatcattctatggccaggagagacccattcacagagggcctcccccagggtgggaggccggggttcaggccccacaacccctctggctgctttcccgttgagatcctgctgtggcccactcctcgtgcccagtgctacctgagccggccatcaggtttgactgcccccagctccgacttggggtcagggctgaaggagctccaggccgtctggctgcaggtctgcatgaccgggcaggctgtggggcccgtggcacagatgtccatggcagtccacatcccgcccaccaacgagtccagccatccctccagcgctgtgcccgtggaggctgcgttcctccgtgcctgttccacctgggcggggttgatgggcaggctgaggacggggtttaggctctggaagctctgctccatgtaggcattgcggaggggcccattgtgcagcttcagtgcctcctctgaaagccaaagggaacaatttcaggatcagaagagccaccaataggatgcctattcatacttaccctgtgcctggtgctgcactgggtgccatgcatcgcctcatttaattcacatgacaatctcatgaggaagttcttttagcagtcccatttcacagctgagaaaactgagcccgtaaggacagagcccactttgtacagggcacggtgcatgcctttattcattcaacacatgtttatagcgcatctttgatagtgcagacactgattcagccaatatatatttttaagcacctacattgtgccaggcattcagtcaacacatatttactaaacacccatgatctgcaaggcactgtctcatttgataaagacatattaagtacctattaggtaccaggatctattctaggtggtggagcaaaccagataggaaggttaagatccagtggagggagaacaacaacaaagaaataagtagataaataaggttatttcaggcagtgataagtgtcatgaaggcaaaaaaacagggtattgagacaagagggttggcaaactgcagtccttgggccaaatgtggcccaccacttgtgtttgtaaataaagttttattggaacatggctgtgcccatttatttgcatattgtctgtggctgcttttgtgctaccagagctgagtatttgagacagactgtattttacccaacaagctgaaaatatatctagccctttacagaaaaattttgctgactcctgggttggagagtgacagtgacctgtacccaggtctgtttgggaagtccagatctcagctgccgagcgtccaccttgtactctgcgtaagttggatttctgcttcctagaagcctaagggtgcatgaactgaccacagaacaatcactctgaaagcatgaagcttggacccgggtgaggtggggtgggaggtcaaactagctctcataacagtgctgccttgctgggcccctcctatgtgccagtcactttgtgaagcacttcatacaagagcccaggtactgcagtcatgctgtctggttttgcagccccacgtccaacataccaggtgtgtgacttctgacctccatgccttgtacctcagtttcttcatcaataaaatgggtaaagtactaatgccttccttctcactttgtgaggcttaagtgtgctgactcatataaagtatttacaaatgacacctggcatatactaagtgctgggaaaagcttagctagtgatatggtttggccgtgtccccacccaaatctcaccttgaattgtagctcccagaatccccacgtgttgtgggagggacctggtgggaagtaattgaatcatgatgagtttttgccatgttgttcttgtgatagtgaataagtaagtctcatgagatctgatggttttttaaaggggagtgtccttgcacaggcgctctggcctgccaccgtgtaagatgtgcctttgcttctcctttgccttccatcatgatggtgaggcctccctgaccattgaaactgtgagtccattaaacttcttacttttataaattacccagcctcaggtcattattagcagcatgagaacagacaaatacagctaggattattactgttggtattagtccataatcctcacacacctaaaaaactagggggctggttttatcattcctactttacagatggggaaagagaggcagctggagttagagacagatctggggttaaatccaggaccgactgactccaaaggcagtgcttatcactcaccctgatactctactgctcaaggccatcaccaaggtctgatttttcactcatgcaaaaattcaaacaattgggccaggcacgatggcttacacctgtaatcctagcgctttgtgaggctgaggcaggtggatcacctgaggtcaggagttcgagaccagcctggccaacatggtgaaaccccgtctctactaaaaatacaaaaataagccgggcgtgatggctgatgcctgtaatcccaggtactcgggagggtgaggcaggagaatcgtttgaacctgggaggcggaggtttcattgagccgagatcacaccattgcactccagcctggtcgatagagtgagacttcatctcaaaaaaaaattttaaaaattgcaacctcaggcataaatgggttaaacagtaacatgtacgtaagagtgactactactactacctcccagggctgcacgatgaggaatcaggaagtatagcaatttggggtgaaggaaagaagctaaacacttctattatttctaatagatgctatttctaatattttgaagacgttcacattcattgcttgttttattgctcagtagaagcacatatatatttttaaaaaggctggccaatgagtctggtgagttgcgctttaccaaatcaggctttgcgagagctgagatagctaggattacaagaaaccttccaagataatgcagtgttcagaagacagtgcttcctgtttgcctgacagcagctgccaccaccaaaggcacccaggacagcctggatattaacaagtgtccagagcaggcaagaagaaggaagaaagaccatatgctaacccttctaaaagcagtgagaatagtagatgaattcaaaatttgccttgactaacacagacaagatcgccactccttcaattcccaatgccccaggaagcaaaagggttgggttctgtggtttggatgggcacaagtgggaggaaggaggtgagcagtcattgagcacatactctgtctcgcaaggggtttagcaaagctgctttctcccacggtagttaggagccacagtgtttggaagtctggtcctaacccatctttctctaatacagggtagggtgggcagcttcagccccacctgccaggagaacagagcctgctgtctttggtgcgggccctaatttctctatcagagccccttagtgcctctattctgcagagtgagaaagtggagaatgaggagataccgaaactgacaaaaggcaggacattcaaagggaaaagagcagctaacaaacctgcgaacgctgggagccaaatattgtggttgatgcaaaaaaacccttatgagaaatgaggttaatgtgggaaacgctattacaatattagcttgcgatgctcgtctctataattaaattttcctcaattccacctcatcggatttcttgcgattaccagggacgcatcaatagaaaattactcttgatgaatcattttacaaattgcattgctcccacctttgtgttcactgtcattcattggaacatcgctaacaaatacaattaccaaggacaggagggctgctctcggtgggggtaaaatgactcctgggtcatcctgggcatgtgtagggagagccctgccttccttagaaaccctagaagaaaacactggaaaaatcaggaccccatgaatggcccccaggctactccactggcgtgggggtgtgttcaggagcactgcttcattctgaccaacaggtgtacctgaagcagcgaagacacagccatttactcccctctcctccatgtctggcattagacatcgttagagatggtaaagatgtgaactagatcaagaaggaacctaagacctctaagggggtgggattgggcctggtcagctctggaggggctgtcttttgcctggttcatggggaagaaggagcaggcttccagctcaagaaaacatgaggtctctgtctttctgcttgctctgcacaaagacagcagaagctgagcgtttacttcgagactcctatgatagaggattgattgattctttttttgagacggagtctcgctcttgttgccaggctggagtgcaatggcatgatctcagctcactgcaacctccacctcctgggttcaagcaattctcctgcctcagcctcccgagtagctgggatcacaggcacacgtcaccacacccggctaattttgtatttttagtagagacggggtttctccacgttggtcaggctggtcttgaactcccgagctcaggtgatccgcccacctcagcctcccaaagtgctgggattacaggcgtgagccaccgtgtctggcctatttatttattgttttggagatgatagagtctcgctctgtcacccaggctggagtgcagtggtgtgatcttggctcactgcaacctccacctcccaggttcaagcgattctcatgcctcagcctcctgagtagctgggatttcaggcacccgtcaccatgcctggctaattttttgtacttttaggagagacagggtttcaccacattggccaggctggtcttgaactcctgaccttgagtaatccgtccacctcagcctcccaaagtgctgggatttcaggcgtgagccactgcaccaggccatgatagtggtttttgtccacggttcttggctcagaactcctgtaacccttcttacagtcttttcttacaatgttgggcactttaggactcagcaaatagaatctctctctcgctctggcctcctcctgtcccccttctcctgcctaatgccagagtctaatcagattgtgggtgataggactctcattccagagagggccctgacacactccctggaggaaggaattactgcacagagaggccaaggagaatctgaacagacagggcttgctgagttaggtcagaccctttttgtccaatcacattttgacacagttgtcatgcttcagtcatgggtaaccaatgaagtcttcataaaaggcccaaaggacagggttcaaggagcttctggagagctgaatacatggtagcatcttcacaggaaggtgaggaagaactcatccacctgccgggacggtgggcaccccaatgccatggggacagactcatccacctgccaggagggtggtgcaccccaatgccatggggacagattcatccacctgctaggagggtgggcatccctatgccatggggacagactcatccacctgccgggagggtggtgcaccccaatgccatggggacagattcatccacctgttgggagggtgggcaccccaatgccatggggacagaagctcctgcactcaggactcctctggaccttgccctctgtatagcttcatttggctgtttatctgcatcctttaaaatatctttcataacaaaccaatagacataagtgtttccctgagttctgtgagctgctctagcagagtaattgagcccaaagagggggttgtgggaaccccagtttgaaaccatttggtcagaagttccaaaggcccagacttgtgattagcgggcagaagggggtggtcttatggcactgagccctcactctgtggtgtctgatgctacctctggggtggagagtgttggaactgaattgggggacacccagctggtgtctgctgcagaactgattgcttgcttgctgacggggaaaatttccccatgtattttgctgtcacagaaatcttctgtgttgatcatggcagtgtgagagcagaggaaaagtggtttgagagtttttcccaaacaactccctttgctaggactcaaggcacctcctccccatgctgtgtccccatccccttgcatcattggctaaaaggcacccaatccagaactcttcaaagctaagaggctgtaatgcatttctggcttttgagtttgtgatctgttagagatggacatgaataattccaaatatagagagacccagaaatcctgtttctacgagtttgtgttatggatgtaactgcatgggaacatacaatttttttttcttttttgtttttgttgttgttttttgagacagagtctcgctttgtcacccaggctggagtgcagtggcgtgatctcagttcactgcaagctccgcttcccgggttcacgccattctcctgcctcagcctcccgagtagctgggactacaggcacccaccaccatgcccagctaattttttgtatttttagtagagacagggtttcactgtgttagccaggatggtctcgatctcctgacatcgtgatccacccgcctcggcctcccagtgtgctgggattacaggtgtgaccaccgcacccggctgggcacatacaattttatgtttaagactcttccttgttggggctgggtgtggtgggtggctcacgcctgtaatcccagctctttgggtggccaaggtgggagggttggtttagatccaggagtttgagaccagccaggacaacacagaccacacaaccacaaaaatagttaaaaaaaaaaaaaaaaaaaaaaaaagccgggcatggtggcacactcgtgtagtttcagctacttaggaggctgaggtgagagaattacttgagcccaggagctcgaggctgcagtgagctatgattgcatgactgcactccagcctaggcaaaagagcctgacctaaattcttttttttttttttgagacagaacctcgctctgtcacccaactggagtgcagtggcatgatttcggttcactgcaacctccgcctcacaggttcaaacgattctcgtgcctcagcctcccaagtagctgggactatagacgccggccaccacactcggctaatttttgtatttttagtagatggggtttcaccatgttggccaggctggtcaggctggtctcgaactcctggtgtcaagtgatccgcctgccttggcctcccaaagtgctgggattacacgtgtaaaccatggcacccagccaacctctgttatattaaaaaaaaaaaaaaaaaaaaaaaaagacttttccttgcactattatcagtaacatcatcatcatcagcagcaacaacagaaacttatgtgtccaccaataggggaacagatagattgtggttccttaacccagtggaatatcatgtagctggtagctttatatatactgacttagaaagtaaaaaaaaaaaaaaaaaagcaatcttacagtacacaatgtattatttcatttttaaaaaatagcaaaggttttgtgatttatggtgtgtattatgtttatgctttacaagtatggaaaaacttctaaaaggattcacaccagactgttggcagtggtttctctagaggtaggatttgagcagggagaaagactttccccttaataaaaggaggtgaaaaggggcgggggaaatagaagtataaaagtaaaccctttcaatggacaaagaaaaaagtcaggcaggataggaactgacatcccagtccctgttctccatggggatggaaaccctgacctgaatttcatgttaatttcatgtttcatttcctaacagctgcctttgacatacgactcctgaaataagatattgttgactttgcctgtttttgaacttgacataaatacatcataattatgatttatctgtgatatttccccctcaacactatgttttagggactcatccaagccaacacatgcccatgctttactgctattcacggctgcatagtactccattgtatgaacagccagccaattgtttctcctttccagtgtcaggcaatcagaccgtttctggttttgtgctattaagaataattctcatgtgagcatttctgcacatgtctctagggcctataccttggggtcagacgtctgtggtagggtgtgtgtatgttcagctttactaggagatactaaaacattttctaaactcgtcttagcacttcaccctcccactagcactgcatgaatgcctattgctctcagccttagtaacacaggttcttatctgtcacgcatttcccaatatgatgggtgtgaagtggaacctctctttgctttcaattttcatttctcccatttttaatgaggctgaacatgtttttgcgtgtgtgaggggccattcatgttctctcctccatttttttcctctcttttatagcagggttggtggtctttttttttgtaaagagccagatagtatctttggctttgtgggccatgcagtctctgtcacaactattcagttctgccactgtagctctaaagcagaagcaggcaacatgtacatgaatgagcatggtgactgtgttccaataaaactttatttacaaaaacaggtagtgggctggattggccaacttctgatgaatagcatttctttataaattctgaacatgagtactttaaaaaaatgtagcaaatatcttctactattatgtggttcatcttttccacctagtgtatcatatttttgatgaacagaatttcctgttttgatttttttaaaatagtaaacaagatttgctgatccttaatacctgcctgggtttatttcccatcttgtcttcaatatgatctaggctttctggaagttgaatgggggagcgtctaacaaatagctacctaatacctagacagatgacatcatctccgtgtgcaggtaggacattagatggtttctctagggaaacacagagaaaagtattgagagcaaggagtgctgttctgtgaggccgctgcttaccctatgtctgagcagtgctgcctaccaacaccaaagaccctcaaggtccccagggaaggagtatttctcccacatagacactgggagtacttaccaggtttgatgggctgcctgttcgagaaggtcagaggcgcaacgaggaatttggtctctgcaactggcacccagtggtggagaattttcactgtccagaccccaggcctcaggggcaagttcaaagggggcttgtagtgtgtgaattcggcagtggactcaatgaggatgtcgtaggtggctgcgatgacattgacgggatccacccaaatgacggtcacggtcacattaggtcccttcccccacttctgcatacccaccggctcatccatgggccccagaagacccccaaagttgcggaatagcctctccttggcatcccagtcagtgccgacctgaaacaggggagtgaattctgaagtcactgggcctgaactagggggctaggtctcagaaaggtctaggatcccctttgttagctttcatatacccattttacagatgaagaaactgaggctccaactaagtcacctgctcaaggttgcacagcttgtaagcagaagatctggcatctggactcagtctgaaggatcaaaaggcctgtggtccttttattaaaccaccgggcctcctgtgcctggtgtatggcatgtgctttgaaaagaaaaccacacatgagctgaatgagtgaatgaatgaacgaatgaatgaatgaatgaatgcatgtcttgcttgcaggccattccacagaaacatacaccctgccactcaacaggtacagcgggtttccaattccatccttggttttctaaatcacacacctccacttggtgcaatggttctgaacaagaatagagatcatgtttttacagctgctctatcataagctagagaccctcagcattgcctgtcatctacaggggttcaaataggtttcctaggaagagacagctttggctttcccaaggcacctagatctggactgtaagcatgagagtcatcctgcgatccttccttcctgccagccagctgggggtgtgtgcagctgtgacccacagcaatcctctctggtgggcttccctccttccacttgtgccacctgcaatttcttctatatcctgtagtcagaaaggccttgtaaaatgtcctcttactgctgcccccaggcttcttagtgcactcagagtctgagctcaccccatcctccatctccatgaccccctccccatctttctccaggatgccttgttttagccacctcaatcaaggcaggctcattcccagctcagctttcctgcaccatctgccctgtgtggaatactcctttcttgcacagccagccccttatgtctaaagctgcctcacagagtctttatctgaccaccccccaccccaaatttcaaatggaccttcagtcaatctgtgtcattccctactgctttattttcttcctatcagtggtgataagcactatctcagagttgtatgttgatgtatttattctttatctcctccagctgtaatataagctctgtgtgaacaggggttttacctggctggttccctgctctttcttggtgcctactaccatgcttagtacacagcaggtgctcgagtaatgtttgttgaatgaatgggtgaatggcttgaccaaaaactgaatgaactagggagattcctgacaaggacctttgttgctatttcaaatcaaattaaattaggggtcatctaatttgaaaaaaagatctcccccaggtggattaacttagtggttttgaggacacagcatgtgggcatgttggggcaaataacgggtacagtatgaagcttgcactgcctctgctgtcttcccataattagcatctctaatgtgtgtgtgcacgaaggtcgggtgtggatacacatacccacattctgagatttcctatgtgcaggggaaataggagctgatctagcttctcattgttcttgcaagaggtactatgtcagtccattctttacccagcttacagagcttcactgctaatatttgctgagggattacagtgtgccaggcagacgtgtccattcagttgatactcccaaatccataaaggggagacccttgtcattatctttactttacagatgtggaaactgagtctcagagaagtgagataactcgctatggtcagagggggcagagccagcatgggaacccataaagtccagccccagaggctgcattctcatccactgtgctacatattgccttccattcatgaattcattcactctctcagtcattcattcacccaacacacataaaccaaatccctactgcctaccaggggtggctgccatctgtgtacactcactggcatgtgtcttgctttcagttttcatcaggccagagactaaagattaggactaagaaagcatcctgagagtaacagaggtagttactgctctgatgttcctgtgggggctgccatccctcccagacttatgaaatcttggtatttttctactaccctgtggatcagcagggaccagcaccttctgggaccctccagtgcctagcatagtgcccggaacacagtaggaattaaaaggatactatttattgaaggaataaatgaatgatcaacaggattcagttcaagcttcaaggtcttagaggtttttctaaagaaacccgatttctattttcctgcttacaacccctttcagcaactcttggtttctaagtccagttgctttacctgtcctggagacctttctggtctggctccggcttcacttctgtcatctctatccctctccctcccttccacttgctccttgctccaggccaccctgggttattcccagcacctcatccggaagggctctgtgtttcctcttgatcttctggccatgatccgcctgttctctggaccggtctacctttccccgcatcctccaggccacctcaaacttgtaatctagattttggctcaggcatcacctctactcataagtctttcctggatagaggcaccactgaggtacatatctaagcatttgatcatcatagcttttctcctgacccccacagtactgcatcttttaatttacaggtctctctctctccagatctagaccgtcaactccaagagggcagggactatatatggcatgctcaccaatatgtctctagtgtctgaaacagtgctgaacatagagtaggtgctcaatatatctctatagagatctaaaaataaagatatattgagcacctattgtctattgatcgatcaatgatctatacagattgatcatctacttatgtgtgtttatcatctatctctaccaatctgtcacattaatctgtcaactctattgtaaccattaatcatctatccatctgtttgcctattaacgtatccacccatctgtctgtctgttaatcaatctatgtatcacctgtctatcaatctatcttgaacacatattgaatgagtaggggctgaacacatggacttccctccatgcactagtttccaacagatactaacaaaacagatgaatggccacaaaactactttagggtcatatttaaggaggtgatttttcaccagttaggggaagatgggaaccctccagaacactgcccttggatcctccaaagaaatgaggataaacacttccctgaaatcgagttttaaaaccaagataacctgggcaggagagttctggagcagctgacaaacaacctggatcttgtttttcaaccgaggagcgtgaagggtgaggtgtggggcagcctgagctagggccctgctgctgtcacatcctccaagaccttctcaaggggcctcattgtggaagtccaccaccatccactgcagaatggtcaattacccaaattcaaatacatattcaaattcaagcttaacatactgctccctggcttccaaccaaccaatggctttccattgcgtttatttatttattttttgagtttataatgtgtatgtatatgtatatatttcaataggtttttggggaacaggtggtgtttgcttacatgaataagttctttagtggtgacttctgagattttggtgcacccatcacttgaacagtatacactgcaccccatgtgtagtcttttatcccctatatcccctcccctatatcccccaacccttgcccatgagtccccaaactcactgtatcattcttaagccttgatttcctcatagcttagctccctcttatgagtgagaacatacaacgtttgcttttccattcctgaattacttcatttagaataatggtctccaattccatccaggttgctgcaaataccattgtttcgttcctttttatggctgagtagtattccatggggtatatatatatatatgcgcacacacacacacacacaatttattcactgattgatgggctgcttccattttttttgcaattgtgaattgtgctgctataaacatgcgtgtgcaagaatcttttttgtataatgacttacttttctctggtagatagcccacagtggaattgctggatcaaatggtagaactacttgtagttctttaaggaatctccacattgttttccatagtggttgtcctagtttacagtcccaccaacagcataaaagcgttcccttttcaccacatccatgccaacatctgttattttttggttatggccattcttgcaggagtaaggtggtattgcattgtggttttgatttgcattttcctgatcgttagtgatgttgagcattttttcatatgttcgttggccatttgtatatcttcttttgagaacggtctattcatggccttagcccactttttgatgggattgttttttcttgctgatttgagttccttgtagattctagatattagtcctttgttggatctacagattgcaaagattttctcccactctctgggttgtctgtttactctgctgattatttcttttgccttgcagaaacttttaaaattaagtcctatctacttatctttgtttttgttgcatttgcttttgggttcttggtcattaagtctttgcctaagccagtgtctagaagggtttttccaattttatcttctagaatttgtatggtttcatgtcttagatttaagtctttgatccatcctcagttgattattgtataaggtgagagatgaggattcggttccattcttctacacgtggcttgccaattatttctgcaccatttgttgaatagggtgttcttttcccactttgtttttgtgtgccgtgttgaagatcagtaagtatttggctttatttctgggttctctattctgttccactgttctatatgcctttttttataccagtaccatgctgttctggtgactatggccttatagtatgctttaaggttgggtaatgcaatgcctccagatttgttctttttgcttagtcttgttttggctatgcaggctcttttttagttccatatgaattttaggattgctttttctagttctgtgaagaatgatggtggtattctgatgggaattgcattgaatttgtagattgcttttggcagtatggtcatggtcacaatattgattctacccatccatgagcatgacatttgcttgtgtcatctatgacttcttgcagcagtgttttgcagttttccttgtagaggtctttcacctctccttggtgggtttgggtttgttcttgtttctctagctcattaaggtgtgaccttagattgtctatttgggctctttcagactttttgatgtgggcatttaatgctatgaactttgcacttagcactggctttgctgtatcccagaagtgttgaattcaggagcaagttatttagtttccatgtatttgcatgaatttgggggttccttttggagttaatttccaattttattccactgtggtctgagagagtatgtgctgtaattttgattttcttaaaattgttgagacttgttttgtggcctatcatatggtctatcttggagaatgttccatgtgctgatgaacagcatgtatattctgcagtcgttgggtaaaatgttctgtaagtacctgttaagtccatttgttgtagggtatagcataagtccattgtttctttattgactttctgtcttgatgaactgtgccaatattactgtgttgctgtccatctcatttcttaggtctagtagtattgttttgggagccccagtgttagtgcatgtatatttagattgtggtgttttcctgttggactagtccttttatcattatataatgtccctctttgtcttttttaattgctgttgctttaaagttttgttttgtctggtaagaattgctactcctgctcacttttggtgtccatttgcatggagtatcttttttcacctttttaccttaagttcatgtgagtcctcaggtgccaggcaagtctcttgaagacagcagacacttggttggtgaattcttatccgttctgtatcttttaagtgaagcttttaggccatttacattcaacattagtattgagatgtgaggtactattctattcatcatactatttgttgcctgaataccttggtttgtttcattgtgttgttttgcaggacctgtgagatttatgctttaaagagattctattttggtttattttgaggatttgtttcaagatttacagctccttttagcagttcttgtagtgctggcttggtagtggtgaattatcttagcatttttctgaaaaaactgtatctttcatttatgaagcttagtttcactggatacacgatgcgtggctggtaactgttttgtttaaggaggctaaagacaggacccttctggcttgtagtgtttctgctgtgagaaatctgctgttaatctgatgggttttcctttataggttacctgatgcttttgcctcttaaggttatttcctttgtcttgactttagataacttgatgactatgtgcctaggcatgatctttttgcaatgaatttcccaggtgttctttgaacttcttgtatttagatgtctagatctctagcaaggctggggaagttttcctcaattattccattattcaaacttttagatttctcttcttcctcaggaacgccaattattcttaagtttggttgtttaacatactcccaaacttcgtgaaggctttgttcattttttaaaaattcttttttgtgtttgttggagtgagttaatttgaaagccttgtcttcaagttctgaagttctttcttttactcgtttgattcgattgctgagactttccagtgcattttgcaattttgtaagtgtgtccttcattttcagaagttgtgattgtgttctatttaggctatatttcactggagatttttccattcgtatcctatatctttttttttaagttggacttcacctttctctggtgcctccttaattggcttaatagtcgaacttcttaattgtttttctggtaattcagagatttcttcttgatttgaatccattgctggtgagctagtgtgatcttttggggatgttaaagcaagccaattcacaattccttggctgtcccacagtgcctgcaggggcaatccacctccttcaaaggctctatggattctcttggctttcctggcatgtttctgcagtagttcttggagcaaaagttcatgatgtggggctccatacactgctctgtccatccgagtggaagctgcaagtttgtcttgcctcctatccgccattttccctctatctttccattgcatttaaaatgcaacctgaacatctttcccgggcctgcaagactactccctgaggcctctttcctaccagtttccttctcacttgctgcacccagtacattggtctccctgcaactcgagtactcctagctcattcccagtgcctaagggcctttgtatatgctcttctctctgcttggaatgctccagatctcccgaggactggctcttttacaggctttagctttgcagtgatctccttagaaaagccttcctagatgaatcaatcattctattgaaggttgtccccatcaatgtcctgagtccccagcaatcacatgaatgaagttttctctagaatacctgtcattagctgagctgtttgtttttgtttatctatttgctcactcactggctggctgtctcattggaatgcaattccatgaccacaggggcctggtttgtttggttcaccacaatccctcctgaacctggcacactgtaggcacttggtgactacctgcagaaagaatgagcatcttttatttccaagtcaacagcatgagattcccatgtattggagaaatgtatctgagctgttcagccacctgctgtgagccaggcactgtacaaggccctgggatagtgctaacaccaaggagatcctaaatagcccacagagtggtcctgtagttcttccttgcctttctgttcatttgctactaaaattaagagtttagaaaaaattcaaaatacaagttagggctctctgcatcacatgctgttatttttgccagtgattttgatggttctcactccaagggtaccagacctgtgtagtgaggaccatcccccaaaagcactagccatggagcggccaacatcatttgtcactgccagaagtacccagtcacccaacagcaggctgataaacagggagagcccagacaccaggcattcatctctttaatgggacattaatgttgtcaattggctgctcaggcccctagcacagaatcgaactggggcagtatctaattgccccctgatgccagtaatttatggaatgggctcccttggctgctcacatccagcaaatccactgggagtcttaattgaaaacagtggcttaacaagaaactctcactggtgcctgtttgtcatggggatacatacattcgttaggcagggccacagaagctagagaaggactgtcaaggaaaatataagagggtgggactccccctctccccaacatactcttagcccctcaagatgtaccatagtctacaatcagactcttggtccctaatccagcagtcagaaccattgtgacaaatcacgtccttagcacttagggatgtgaggaaggcagaaaccaggtgctgcagttttgtgtgaataacacgcaccaggcttgatcatgcttccccttccttcctgcaccacgacccaagtacactcattcattcattcaaaagtcttactcagcatctacaaagactacatactgtctgtgtgctggggataccacagtgaagagggagacacagttccagctctcttgtgaacaatcaatgagtgaccagataaagcaacaagataattttagatagtaaatgctaagaaaaagtattaaaatagggaagggttggatggagaatgtagctattgcagcagcttaagtgggtgccggggaaggtttctctgaaggtgtatcatttggatttagatcagaatgatcaaaaacaaagctagctatgtgacccatctgtccatccatccttccttcaatccatcattcatctactcatctaatcatatattcagtgattgatctggtacttcccttgagcgaatccaggtgtgctaaaaactgtggagacaaaaccacaactaagcataggatttgtggccaaagagacctaggttgaattttgagctctcccacttcctagcaatccagaaaatctttggatctctataagcctcagttctccattcggtaaaatgggactaatattactgacattggtttaggagtcatcactggaaaaattcagaggagcagaaattctaccctaaaaaatacaactgtgttccagttggtttgatcctcccctgtttaagatgctggtgccagtgactggggccggagaaccttcttcgggcacagggttagcttatctttagggatctccaagtcctcttctcctccatctccaactagaagtgtcagatagtggagtagaatctggccgagggaaatgcaaaatacaatgaaatgtgacaagacctggcctcttacctcggaaaactgaagcctcccaaagtcactgggtgggcttgcgatcttgaagacttttttcggcatcacccaggtctccagagtctctagtttgctcacagccagattggtagcatgatgcttgatcagaaagccctggaagcggtcagcaaggaagtagaggtgcacagatgctgggtggcccattgggtagtatctgaaaacacaggcgctcatgcattagggcccaaggtgtgtaggatcacagtgaggctccccacccaccaagctagttttgttcctaaagcagtccccattgtgcacaatgcctactgttttccttgcgtcctctgtatctatgatctcaatgactatgaatacttttttcttctgctgattatgaatgaaaaacatgctgactgtaggaaagtacaacaaagaaagtgaaatgactactttccatgcctcttcccatacataatgtccattcacagatattgagtcctctggtgcttggtaccgggcagtgaaaatggtgtgtgaacactcatattgatggatttcccttcggccttatttcctatgcatctatttgcataaatactatttgcataaatactacatagttggcatctatctatcctagctattattctgtcttcattgtatagtatttcctgaggattatcacatctttgaaaagtctctgaagacacgattttgtatgtgttgatgctcggtgtgtttcatcatagttaataccagatttgatagagcaagttctctagcattggatgataactctaattttttgcttctctaaacaatgctgcattcaacatctttgagcaaaacctttcattcgtctctctctctgtttaaatgtctgaggctcttcgtgtctgcagcttaactgtttcagaagtactgatttattctctcacagtccttaccacttacactggttatcatctttaaccatgattgccaatctgagataaacacacatgcacatacatgcaaaagtggtttgttgttttaaaatgcacgtctttgatccacaaaaacttgctggctgaaaagggcagggaagtgaagcagagatgtccggagaaaagggggaagcagatggcaaaaaaggagtacctcggaggagaccagtttggtatatttcctacttgtcagataaatagctgccgcttctgcaatgtgtaaattgcacagctttataaggcgcttgtgggtccttcataatagcatttcacaaatcattgtccctgctcagctaaacgcagccttccctctggtcctgatctggagttttaagtctttatgtccaattataacagttagggaagctgccttcctgtgttcacacatctcctgaaatcattgccttgttactgggatgccttccagggagcatagaaaaaaaaaaaaaaaaaaaaaaaaacttgaacagtcttcagatggtttgttgggcattcaccgttcatgcaaacctgttttaaatctggactttgggagtggaaagtccagcgactgtgctgtcattctaccactgcagcaacatctaggcagggctatcacataaaacctcctgcgatgacagaaatattttatttatttatttttgaggcagagtctcactctgttgcccaggctggagtgcagtggcatgatcttggctcactgcaacctccgcctcctgggttcaagcgattctcctgactcagcctcctgagtagctgggattacaggcatcagccaccatgcccggctaatttttgtatttttagtagagacggggtttcaccatgttggccaggctggtctcaaactcactcctgacctcaagtgatccgcccgcctcggcctcccaaagtgctgggattacaggtgtcagccactgcgccaggccaaaagctttttatttccataggattttggggaacaggtggtgtttggttgcatgagtaagttctttagtgatgatttgtgagactttgggaaagctgtctcccaacccactagcaaagtgtgactgttcagcccttgaaatatggccaatgtgactgaggaactgaattttaaattgtatttagttttagttaatttacactgaagtagccacttgtggctaccgtattggacagcaaagatagtcatgaaagagccagtggtcacctgcattaatgtcccaaatctcccatctcctttatcttatgctttcttccatgtgactttgcaagtttccttgtacccgggaggcagaacctatttttctacctctggaatcttctttggacaacagaaagtggtagaagggctgtcacgtcagttctgagccagggcctcaagatgccttgcacatttctgtttgctttcttgctcttttgaggtcaccatgagagcatgcctgggctagcttgctggagaaggagacatttgaaacagcagagctacgccagttgtcccagctgaagccatcctaggctcaggcaactattcccagccaaggaccacagagccacctcccgacttgcagttggctgcagataggggagcaaggcctgcccatactgggaaaactgtccagctgatctgcgaacttgagcattacatgaatgcatattgtttcaaaacactgatttgggagttgtttgtttcacagtgttatcgtgacaatagacaaagcactgccagtgtgtgttctgtgaggtgggtaaagcaggagaatttgctgttacgggagtcaaaggaagagagtgtttccagaaagcagcagtccaaaaaatttagaagtcaatctttgattacttgcctcccttcaccttctttatattttttgagatggagtctctgtcacccaggctagagtgcagtgtcgtgaaactggctcactgcaacctctgcctcccgggttcaagcagttctccctgactcagcctcccgagtagctgggattacaggtgtcagccatcacacctggccccttccatcctctattctccttacacactgccagaatcccggtcaaagccaccatccttttatacctgggcctctgcaggagcttccttaattgtcaccctctcttacttttgcccactataacctgttcccatagtagccacgtccatcgtccctcacttaaatgccacaagcactttgcttcatgctttcagtaaaatccaaactccttacctggtccacaaagccctaccgctttctctagcccccttttgtttcctgctaccctaatccaccacttccttcctcattgctgcctctgacttgtcactctcacatgactttatcttcattttttgcacagcatttacccttattgatcttatattctggtttacttgtgcttaggtactgtctgtctgcacactagaatgggagggctttgagttcacaggcctggtccgcctggatcaaggctgaattctccgtgcctaacacacaggctgacacacgatagctactcaatcagtacttattgaaggagtgaaaattctagaaggattttctcttgaacctcaagttacatctacagtccctgtaaccaaggagtgagcacaaaagccctctgatgcctcatcctgactgtatttggtatctaagtaatgaaaactgttaatgtctcaaaacagaaaaataatcaagatgccgcacaaccaatcatcatctacaggaatgcaaccgaagtattcgtttggcccaaagctgtttttctttcttatttaaatacgatgagcactaaaaaaaattaggagatttggttggcaactccatctgcattcccacggaatgtactggggttcagctccatggacctccaggttcccatggtcagcccaccctgcagggggcacactgagtgattctagtgcttcgtgcctgccccggagggcatttggggacctgcaataaaatgctgacatccttatttctggatggtagattatatgcaaactttactctgattctctcaacctgccatttcagaaacttctgcaatgcatatgtgttagtttataatgagaaaaaaaaatcaataaacattatttaatgaaaggttatattatagactggaaaggcacaatttgcctaaaatacccagataaaatgagactgttaaagttttcacttgctgtttccccacatgccccggggctaggaatccattctcttctgccttttgggataagggtcttttgtcctgatttattttcaggctcctattcataaatacattggctttgcccacagcaaggcaccacagttccattacaataaaaaacgaggtggataccagaggattcctggctcgaggcaacgtgacggctcacttcattccaaaatgaatactagggagcaaccttcaacaaccctagataaattgggggtgtcttttggaatttcctgtaagatcatttaccttatacattctaggaagcctgcaactgtaattattatggaacgacatttgccttccaagtggcaggcactgcactgtctactggggatacatgcagggattctgcttccagactagcagtgggggggagagagactccctggtgaccttgagccaagataccgcacatactgaaggtgaagtccctgaactactttcagcttgggagacggtgggtgtggggtgagctatcttaataagtgtcatagaggaggtggtccttggatggctttgttgacttgagaaggggtggctgtgcagtgggaggcagtgagcaaagaaaatacagggagagaacaaggaattgttaccatcacacacagcaggttcactgttggctgcatcataatggcaactggcaactaagataccagcaatgacctgaaccctgagcagttagtacatggcaactggcaactaagataccagcaatgacctgaaccctgagcagttagtacataaaatgctgttaaaatgggaataacaaggctgggcgcaatggctcatgcctgtaatctcagcacttagggaggctgaagcgggaggattgcctgaggtcaggagttcgagaccagcctggccaacctggtgaaatcctgtctctactaaaaatacaaaaattagctgggtgtgctggtacatgcctatagtctcagctactcaggaggctgaggcagaagaatcgcttgaacctgggaggtggaggttgcagagatcacatcactgcactccagcttgggcaacagagtaagactctgtctcaaaagagcactgtataactaactcatcaggtagtttttgatgattatctcctttacacttcacaacaccttatgatacaaaaatgatgagtattactcttctcatttcacagatgaggaaaccgaagctcagagagatgaatgacttgcccaaggtcaatagcttgtaagcagagtttaaactgcaggtcctgggttcctaacccacactagtctccctttaaactaaatcagaaactttacggagagagaagccgagggatgtgaggaggtgatgggacagtgtcacagccctgcggaaaccttgctggccagggatgagacaccaggtgggaaacctgcctgtgttttcagagagttagtgaacaatcttcttccccccagccccgtcagagactgacgctaaaaaaaaaagatgctatgttgttaaatgaacaagaaaaagaaggagagtgattagaggcacttctgggaatctatcctaaggaaataatcaaaagagagaatggaaaaaaagggctttctgagaaaagatattcatcagaacattatttacaagggtacattactgacaatggcaacagtgaagggccagattaagcaaactctggaacttctgctcaatggaatactagaggcattaaaaggaatcattatcattgcggaagctactgagcagcgtggagaaatgggggctaatagtataatgccaagggaagaaaacaggatacccaattcttgttgcaattatgtaaatatccaaaatgcatattgcttcagaacaaaagaaagggtacacaacgtgaaagtcttgactggcttagggaaagagatgagaggagaagggattatgttgaattattttcctacctccccctcatcttctagaacactctttcctgaagtgttggcagttagtggtagatgagacaattgtaaggggtggttgagaagtttcaacaatagttctgcctattaattttctttgtgatatttttaggtgtgatgacattatggtgaatgtttttaaaagagttatttttcagagatacattattaaaatattgatggctgaaatgataggatgtctgggattgacttcaaactgatccgggaggaggcggaaggtgggtgaagatgaaaatgaaacaagatcagccccgagttggaaactgccggggctgggtgacgggaacatggggttccactgttctatgttgtacatctttgacattttccatcaaaaaaagttttgtaccttccacttaagacaaatgctacatatgatatggtgacaaaaagcttccttctaaagtatatatatgtagcatgaagaatgagtaaaatcattgggtacataggatatctggtatctgagaaagtaaagcacagcttggattggaaatgccacgcacgctaggagggtggcgttagatgagttttgggcaaaggaagagagaaagcatagggtggcattgcattgcagatccctaaagaggaagaaggacccccactctgtaccctgagcctcccctcctgcttctcagctctcctctctgcatcccatatagggctcaccggcagctgttctccccatccgtgtgcagggacgtctcggcccgtcgaagacccaggcgggcaaaggagtggtacaaggtgagtgtcacgtcgctcaggctgtggatgccgtcaggctcatcgtagacattctcccagtaggagcgcaggcccggggtacctgcagggtagttcccgtacaggtaatagtccagctgcccaatgatttcctgattcaccacggcttcaaacttgcgggcaaagaaggtaggccgggctgtctgctgtactcatgggattaaaaatagaaaagccacatcagcgagtgctgggggttggggggaacctaagggcatatcctgtggttagaagcaaagctctgctggacccgaattagctccgatactttttgcacctctgtgttctcagtttcaacatctgtaaaatgggttataataagggtgtgagttaatctgtgcagaacatctaaagcaatgataggcacttagtaagcatcatttcttagtaagcatcatttagatgtctgttaaataaactaaataattttagatggtaatagctgggatggatctcagacatcatttaggtacaggtcacaggctagtaatctagggcaaataaatacagcctgcagatgtattttagctagccatatttaaaacatgaaagagttcacggaaattcttttggcttctctttaaacagcaatagatctggcaaccccaggcccacactccacatggtaacaactggttaaagctgaagggtggtggctgttcctttagacagcacctaggttcttctgctcactgcagtctccaccatgccctattgcctctttggtatttcagccaacttgcagactcacaagggatcggaatctctgggactttgaaaaattcagattccaggccaggcacacacctgtagtcccagctgctcaggaggctgagacaggagaatcacttgaacctaggaggtggaggttgcagtgagccgagactgccgctgcactccagcctgggtgacagaacaagactctgtctcagagaaaaaggacctactgagtcaatagctctggagtgtagctcaaaaaaaaaaaaaaaaaattcccaggtgattatgattcagtgtttcaggaccactgatagcaaccaaactctcaaggcaacaggcccagagatggtaagggacttagctgagaacacacagcaagtcactatcagagatgggacgaagagtcagggtccagggttaaagaaatactaagcacctgtaagctaccaggtgttatactttatattcagtaaaaggccagacagtaaatatttaaaatagctttgaaaccttcagcttcgcttttatagcataaaagcagccacagacagacaagagactaaataaataggtatggctgtgttccaactaaacttcatttatagaagcaggcagtgggctgactttggcccccagggctagagtttgctgaccccttgtgtagggctgcggagacaaataaaacacaggtctctcccttgaggagcttattattgtctagtgttattattgacctaaagttgggtccagcactgttttcatggtggtagattaatagcagcaacaactactgaccacacacaatacgcagggcaatggacttatgtcattacctctaattttccctgtaacttggcaaggcaggtattatgattcccattttacagatgagaaaactgagctcagagaggcaaagcgatatgtacagactcacaccattgtaagatttgaagcccaaatgcatgactccaaaatccaagccctttctactgtatcactccaggactgaggcaactgagtaaactgggaagccccctgatcgtaagtacccttggtgttattctaaacatctcattgccagtctgcttcaggaaacctctctgtggtggggagcacagcttagcactgtagagagttagaccacctgaattcaaatcctcatttggctaccgtctagctgtgcaggtcaagttactcaaactctctgggcctcagcatccttaaaatgggttactagcatagtgtctagcacatagtgtaggctgctctttgattattatcaccagccccttgttaccaggaacccatctaggggcagaacaaactcctttctctgcctgcgattccgaccatagctggatcttctaacaaacagggcacgttaccatattattctttctctccaagttcttcgcgcaagaactctgagttccttacaggcagcagtgtcttgactctagatcttgggggatattcttaatctctgcttgctgtgaacacatgaggcactccttgtcagaggctacaatgtccccaggatgccgggctaggatacaaatgcttgtgcctgggggagtgcagggctctgggaatcagcacgtggaggttttgtgctctaagtgatgaagattctctgcgattagggcagtgagggacgggtcctctccaaacatgggaattcattgaataggtcaaacaaacattcccctgcaaccctctttcggctcagcatatcctttctgcagggaagatgtgagtttaggcagccccctgtctgccagcttaaggtggctggagctgctgtgtgggaaccttaaggggaatacgaacgacagaaaacctgcagtgtactctgcattcatacaggcacaaaaaccaggaaggcagcagggactgctggaaaaaaaccccacttggaacacccctccatgccttcgtttccttacctgaacaataaaagtgatgtctgccccagtaaagccaatgcccacacagcccggcacagaggagatcaaacacaaacaaacagcatcccgctccacatcaagggcaccttggctgggttatgagcctggcattgtgtccctgccttcctgtgttagtggtttgggaagtagcataccgtctctacacggtggctctagtgacctcagagtgattcgcttaaccattcagtggcactcatatttgtgctctctgctgctaggtgtggggagggctggaggaagaagccaccatgctggcttggagggagcagagcaggaaggggtgcccatcttggggccaagcactctcagggctcatggtaagtggatgagcattccccaccctcctgctctgcccttccccagaactgtaaattgttaggctgcccagagacagctgtaaaggggataatgttctacctcttcttactccttcaagtacacagaacacagtgttttcccacagaacacagtggtttccaaacctggctgctcctcagaaaagtgcaattcattaaaaatacaaattcgtcgatatcactgatgagggtttctcaaccagaggtgctgctaagcatcctacccatgcatgggacagcatgtcccaacagagaatcatccagccacaatggcaagagttctgaggttgaaaagctcagccctagatatatacttaaaagcatattcctgggtacaaatgtaacaaatattttgggagattctgatgaaaagggaataaagagaagatgatatgagtatggcctttggaaagttttttttaacctttctgtgcctcacagttttcatatccctaaaatggaataataatgaaaggtcatttgttgtttttgggttaatgagtcaatgtggttagaacatccctgaagtaagtgctcaataaacactggctattgttgatactgttaactattattaattatcaacagccaggtttgggcaccatgtgataagatgacctgcaggtctggccttggatttctgcagaggtttgttgggaaggcatcacttaggaggctggcagaccatgagaaagtctcacctggaagcggtggaagtcctgcggcttgaagtcattgggggagcagccgcaccagtccacgatgtgcttgtactggcacttgcagcccagcttgcgattccagttggtgatgcgcaggttgttgtccaccatggtgtcgcagtgggggctgttctccaggaccgtatggaagaaggactgcaggggagagagggacccagcctgagacctctcccagcctcccacagatgaactggggtgggaaatggtgaacccttgctctgagttcatgtaagaactggttgtttaaaagaatgtggcatctcatcagaagctgggcggcttcctgtacagcttgcagaactgcaagccaaataaacctcttttctttataaattaccaagcctcagattttccttcatagcaatgcaaaaatgtataacacaactacctgactgtcaagggactcttatgttctctgcatgcatttgaggtcagctgcccatgtggtccaactcagagcgcaggcggatgctctgtccaacagacaaatcaaagggattcaagtctgactgactgactggtgtgctggaatttcacccctggggtagggagaccagattgatggttgcattagacccagggcttcctgcatcgccagacggcaacatagggaagggagtgggtggggctgcttgctgtccatggtactgaaccaggtgccatattttctccctaatcccaggattcttggccaactgctttaagggatctgagaaagaggccatgttggatctgaaaagaaaaactagaggagaaacaatcaatcactggagtacttgagagactgccagagagtgagagaaagatttctataatagacagtcccaggcaaatatatttcctccctgttctctctccctaagggaagctgttggggaatctgtgtctgcccgttacaagttaatgggcacagccttctgatttcttctaaaccagtcctcttgaagtggtctgggagaagggagggaaggcagagatgcaggaggtgggactgaacagagaccctggagtatatgtgcttgtgtgtgctggggccagggaggggcagagaaagcacacacacggagctttggtcaccagtatcgtggtgggcgtcttgattaaaaatagccaaactcccaaacaatctcttctaaatggatgggtgggtaaatgaggctccagccgccaccccctgctgaccttcctgtgacactaaatgacaagcccatgaacctggattttaagcttgaattgcctacaagcccagggaggcatacattctccaacaagcagtgggaagatgtacccaattactgattgccctgtgtcctttcataatgatacagaaattccctgcaatataatggatgaggaggttatcagaattgagagaagaggtgattgatttttgctgaaataggattaaaagctgattacttaacatgtgtgcagaatagtaaaacctggcccagtgatgacaagctcatcatccctctgggtgatgggggcagtcagccctccccggagcttggcactgccccagacacaggtgagagatgtgctgggagtgtggcctgcagaaacacacataacctatgtggtcccgggaaggaacaagggaccgttcatgagaaatgccatagactcaatagaaacggaaccagctctgcactgttctcaagctggattggaaatgagggtgcaatcaacctggaggtcaggaagatgaatctggaatccctcaacccagctctgaccggcaggcagctaagggaatgtcagtgacaatccttcagaactggatcccctccccacttctagatggggctaggactgttttagaatactctggattaatggagtatgacttatgaaaccaacacccttttcttcagggaataatagagcaatgttcaacatgagaaaaggcatgcttggtgtaaaaaggtggtcattacatgattggtcattgtgaaggatgcgtcaaaagttgatgtggcggccgggcatggtggctcatgcctgcaatcccagcactttgagaggctgaggcaggaggaccacttgaggccaggagttcaagaccagcctggccaacatggcaaaaccccatctctactaaaaatacaaaaattagctgggtgtggtggtgggcgcctataatcccagctactcaggaggctgaggcagcagaattgcttgaactctggaggtagaggttgcagtgagcagagactgtgccactgcagtccagcctggatgacagaggaagactgtctcaaaaaaaaaaaaaaaaaaaaaaaaaaaaaaaaagttgatgtgggtgtgtcctgaaagggtcagcatatacagttgtgcaggttacacactacataccttttaggggtgccatcagcattgtggatgtcagaagggttttttaaataacagttttctggaaaatagccataaggttcttgttctaacaaaatctgtgtatcatgtgatttttatgaccaatgaaagccaagtatcttgaggaagagctgccttttctattttgcacaaagacactgtgtggactgccggtggtagcaccgtgtgtctactccacgcagcctctgtgcagactggagggagaccaggcatcctgctaagacagcaaggatgtctgggtgtgtagaggacaatgtaggtggacccagaatctctttgccaaaaattcagcatctgctttgccacaaaggctagaacaagcccctatctttcttgggaaaattttcccagatactcacctcagcaggaagcagggtgtaggagtagaactgtttcatcttggtcaccagatcgtctgtggagaaggtcacatattctacaaacctccggttcagcaggaaccagtccgaaccgccatccacggcaatgccctctgggatccgccgatctcccaggcgccacatgtgagcgtcgcactccaggaagagccgatccaggccctgcttccgaatgaacctgggagggagaaagctgcccttagcccagaggtgtcctgaaagacagaactccagccagagtccaaataaaacaacacaatcatagcgatgatggcaattattgagtgcctgctgtgtgccaggtactgctccagggctctgcgtggagtttatcacttgatccccacaagtgaggcatgtcaccgtatttacccctatgacgcaggtactatttgacccccaactttcatatgagggcactgaggcttagagagcccaggggacttacccagcacagtcagatgacagtgatcatctgctacagctactccttctctagagaactttggcaacaacctccttatgccatagaggtcttggcagtttagtgaatgcagaccatggacccttgtctcagaatagtactcttcaatgcatacaacaaaatatacagggttatgaaacagcgaaaaataaaaatccaccaaagttctgatataaagtaatgcctgtgcttcttgactcacacattatatacaggattacaacatttttaaaatttttattttttgagacagggtcgtgttccgttgcctaggctggagagcactagtgtgatcctagctccccgcagcctcaaactcctgggctcctgtgaccctcctgcctccagctcctgagtagctaggactacaggcatgcatcaccatgtttggctgatttttaaaattatttttgtagagatgggatcttactatgttgcctagactggtcttgaacttctggcttcaggctcccaaagcactgggattacaggcatgcaccgccatgtctggctgctgcttaaatttttttgtagagacagggtctcacgatgttgcttaggctggcgtaaaactcctggcctcaagcaatcctcccaccttggcctctcaaagtgctgggattataggtgtgagctactgcatggggcctggattacaaaatacattttaaaacactgaatgtatggtactacgtgtgtttctttattaatacattaaataacaagatatcatggcaggtctattaaatcctgtaattttttttttttttttttttgagacagggtctcactcggtagctcaggctggagtgcagtggcatgatcttggctcacagtaacctccgcttcctgggttcaagtgattctcctgcctcagcctcctgagtagctgggattacaggcacacaccacctcacccagctaattttttttttttttgtatttttagtagagatggggtttcaccatgttggccaggctggccttgaactcctgacctcaggtgatccacccaccttggcctcacagagtgctggggttataggtgtaagccattgcgcctggcctaactcctgaaattttgaagtagtggtgagcataaatgatatttagaggtatctgcaccaactataatgtgacaggaaaatagatgattcctactggtgaccgagtcagttagttactgctaatactactgtgatttgttacctacctttagctagatttcagttagaattccattaaaaaagatatcattttcttctcatccaaaatcacgaacctcccctgaatttttcccatgaaccctagattaataactcctactgtagtaactatatacatataatcatcttgtttagaattttgcaaggcaggctgggcagagttggcatttcctattttgtagatgcagaaaccaaagctgttcaggtcccagagctggtgacgtgggcatgttgggagggtggacagagctagaaccaaggcttttgggccaaacgctcagtccattagcaattagcattcattgcacacataaccatcattgccattaccatcatcaccattttcattatcatcactgtcactgccaccatcatcatcatctccatcttcattatcagcaccactatcaccattttcacgtattacgtgccaggtactgtgctggcccatggtacaggtcaaggagaagtaaggacgagctctgctcctaaggagctagttatctagatgggagcttacagtctagagttgaactcagggacctttctgctccttcaggctgctggcccttacacacgaccaggactctggatttttcaagcccttatgaataactctattgtatgaatgcttctccacaccaccacagtttccctacacatgtgcctttggtcatggactccgtatgtgctgggaatgattgtcttcttcctctccccttcagtgttccctgagtgaacttcacttcatcgatcagattgcagaccaaaagctactctctcagtccttacagtcttacaacactgtaatttcttccaccatcattgccattaccatcatcacaatttccattatcaccactgtcatcaccaccatcgtcatcatcaccatcatcatcacaatttccattatcaccactgtcatcaccaccatcgtcatcatcaccatcatcatcacaatttccattatcaccactgtcatcaccaccatcgtcatcatcaccatcatcgtcaccaatttcagtatcaccaccatcttcatccccattatcactaccaccatcaccatggcaatgaaaacatatgagcattatcattacaagggctttatatggattatctactttaattctcatgaaaaccccagagacagtacttttattaacccatatttacaggtgtatgaactcagcaacttgccatagcacatttctgtgattctgtgattactgtctaccctttccagtagactacaagcttcatgtgagctagggttgttcttgtttttgctcatcactctgtgcctggcacacagtaagtgcttagcgagtattcacagaatggatagatactgaatccatcaataggcaaatacatgtccagcacctaccacaaccccagccttgtggtgggtacagtgaaagacaggaaacactataaacgacaggctttatcttctaggaactcatagtctgactgggcaaatatgatacaggcacatataaccataggttaaatgagtttcgaggaacttctggaaaaatggggactagggcaagggtgaaaagccagcatgctgtggacttggttggtggtcagggatggcgtcatggatgaggcagggcttgagtcagactaggaggggtgcagggaggagagaaaaatggacattctagacagaaaacagactcatcagagatctggggagcagaccagtttggcttaattgggagattgctctgggcagatgacacagattgaaaaggtcatacatttttaataaagataacatccacacaatgtaaaataacaagagaccaagaaatgattttatgatgaaggggatctaagtgtctcgaggaagagctgccttttctattttccacaaaggcgctgtgtggattgctacaggcagcaccgagtgcctactccatgcaggctccatgcagactggagggggatcaggggctctgctgtaacagcagtggtttaaaattaagcatttaaggtgtacagtttagtggaattagttcattaacaatgttgtccaactgtcacctctgcctggcttcaaaacatttcatcagcccccaaaagaaaaccccatacacattacacagccactccccattcatgctagcccctgataaccatcagtctgtcttctgcctctatggatttaccaattctagatatttcatataaaggcagtcatacaatatatggccttttgtgtctgcatcttttgcttcgcataatgttttccaggttcatccatgctgcagcaggtatcggtgctccatgccttgtttttgcctgctcagcatccatttatgatttttctgggaaccacattttgctttactttggactcatccttaaatctcagtttacttgggtctgtatcctcaccctagcaccagggggtgggaacatgacccaggatggatcagagcatcccatctgtctggcctccataatcaattcagggatgggccagcaatgcaagctgggtctgagactaggtcttggattgttgctggagttagtgagaaggaggggcttttctatgagatttctggcagggaggatgtcagcctagggctgctggtagccatctcatcaccatgaatatagaggttgtctgacaatggagcaaactggaaataggagacagaaagacacagtgccaagcgcttgatgggttcacttgagattctggatctcactgtgcctgaccctctcccagacttgtgtgttatgtgcttaaggcatttttgagatgagattcctcacttgcatttgaaaaagtcctaatacatgcctgaatgatttcaacttaatcacaaccatgatgtgtggggaggttcttaggctccagacagggcaggtagccagggctgtggcacaaaaatgcttcctcttccactgagccagtctgctcagagttctagagctgtctgcatttctgcaacagacctcgttactctgtcttcagactggagttacctgtctcctcgcaggtagcctttattctcactacaacacactttggctctggactttgtgcctcccttccaggtcctaggacagtgcaggtcagctgctcaagaaaagtctactgtgatgaggagacttcagggtttggaagctgaagatggtcctgccctggtagtcacgctgaattccagaaagaattccctctcaccgggcttcccacaaatccactgacattcactcaggggaattacttgaaacctcattagtaaacctacattcttagcatttcttttctgcatgagcagaaaacccacctctagacattggctactatggaagataatgacatagtacacctaagtcatcacaaaatggatgatggtgtaatgaaatggcgatgacggtaacgctggcagggaacagacttaattcggctgaaatgtgcttttcatctgtggggcagtgtggttttacctgtcaccagctgggtgacttcaaaatgttaaggagtcctctctgagtctcagtttctttcttggtaaaatacaaagttggtctagatatgggttgtaaagttagatccctacagggcggtcagacagataatggaagcgtgtgaagcagcctgaatacgaaaaaacaaggactgatgaaattagcagagaagtgaagaacacacattctgaaatgcacttccactcctttaaaataaaaaagcatttctggttgaataaaacatctctctaggatgaatccagcccataagccatcggtccagtcacaataatcctgggttaggtaattcccaaggtactctccagctttgacattctataagtcacattgttatactcaggaaaagggcatggggcaagcaatacatctcatatggatacacgggagcccagagaagactggcaacttttctaaggacacacagaggactcaacacaagggtagaaccaatcaaaagacccagctgtcctatgtcacgggtcttgctctttctctaacacatctttccacatgcaaaatctgagctcattagcaaagccatgttcttgctacagagcagtcctctctgtgtctcagtttcccccttggtaaaatacaaaattgggctaggtctgggttgtgaagttaaatccctataggggtcagacagacaatggaagacagataatccaagctcattagcaaagtcatgttcttgctgggaaggaactcagcgaagattttttgtaatacagtattaacccactgaaatgtaactgagctctaactgggtcatcaaaggaagcccctgagtttaggaaaataaaaccctgccttgactctggctagtgctaattatacaaaaatgtccagtcgatgcacttaaccatgcttgaaactttcaattttagataatttgtattcaaacttacatggttaccagactaaccatgagagacagacagagaagaaatacaggtgagaggactagcaaaatttttctttccagtttttaatttcatgttccattatatgggataatagcatcgtcttgcaattttaatgtgatgtcccggaccataatattcaaatacaatatttatgcagtcatctccaaaatgaaatattcatgggattgggagatgggttgctgtatttatcacattcaaaaactgatatgctgcaaacgcatgctttggttaactaagagtaaatggagacaaccaattccctaggtctcagaaaagtttctggagtcacaggggtgaatggggacttaagtcttggactaggagatggtggcagaggcccagcaacagggtatctaccaggggagaggcatcagctgtttgggcagggatttgcattttttcttccctttctttaccataacttgaaaaggtaaaattggaaggcaaggtaagtcagtgaacacctgagtgactttttataaaatatggctcaccaacaaggggcgcatggctctctcacctgaggcgtgaagcacagatctgtagcaataagccccatatacaaaaggtgaccaatgatacgctcttccttttcatttcccattgagtaggttacctggggcaactggggcaacaggtgacactacagcaaacagacattgggtgatctaggtactaatcctgcctctgcattcacaggctatgagatgtggggctggcttaacctctctgaatgccagtttcctcatctgtaagataagccccatgacacctgtgtcttgacagcctcctgaatcagctgcaaagtgtgatggatgatgcttctcacagggccttgcaaagtgtttagtaagcgctgttcacccaagcaatgaaccgactcaaccatcaatcccttcttacctaaggatgacatccctcccccatgcctggcatcctcaatcctcctttcatgctttgtatttctccacaggacttttcactttctaacacaatatacaagatatttatttagtctgttgtctatttccactcactagatgtaagctgcaagatggcagagatttttgcctatttttgttcactgctgtatccctactgcttacatcagtgcctaccatacaactggtgcttaataaatatttactgaaaaaatgaataaaaagaagggtaacagccacacctgttgggcaatcaggcagtcacagactttcgttaactaggtattggatccttctaacacacatttaacagaaaagaaaattgaagctcagaaaagttatgtaactttcccaaggtcacacagccagaagtcttgaatttaaatgcaggtctagctggatccaatgcaagctcttaactactctgccatctttgatgccctgattcaccatagtcccaccaaaaagatagaaagaacggatctgtgatcttctaatgcttgaaaaagacaatgcccagaaatgagagagaatcaaaagagaagggcttattgttggctttggaagaatctttctgccagacctctggaagatatctgtcttctacctgaggtcaaatatgaaatcatttgcattcagttttacttcctaggctatgaggaaggggcagctcaccttcctgatatttttacctattagcacactaaggaaaaagtcacagctaaatatgatcctattgggacatcccagggaccaaatctactcagctgagcatcaaagtaaatcagacagagggtgggaagaagtcctgattctcccccatgggagaagaagtcagttaaaaaaacatctgtggcttttggaaataatgtcagaaaggtggataacaaagaagtttctcaattcagttaattcactggctacaatcttggtatattcatcaagtatggaattattccagaattaagctgtcccactgtaagttttagaaggaataactctgctcttcaagtttacagcatgtctgagcaagaaggaatcttcacaagcagctaatatagctaatgctacaaattaaaaaaaaaacaacctgagaatgaaagtacaaatgatacatccaaagtcacaatgcctagaaaaaataaaatctcccccttttctgttttcctgtctggtaatctgtcattgaatctagattactccttcagcataagtacaacctaaggattttagttaaaaaataaagtcatggaataaatcatatagacccacaatgcatgaaatcagtcagctatgtgaacaggctcacacatctcttcctaggctctcaggaaagggcagtttagctgcctgagatttttctctactggcacaaagtcacagctaaatattattctattgggatgcagtggcaagattttgagtcctggaatcagattacttggcccaagtcttgtgtcttctactaaccttaggcaactttaatcatatggtactttggtttctcacaggggaaatggtgatcataatagctaattcacagagctggtgtgatgattcaaatgagattgtatacagggagggcttagcacatagtaagggctccataatgtccattacgatgctttatgtttttttcctttatcagggtgaatttctatctgtcctattctctcttctgggatttggtagacaggtacataggacacctccacagctaagaagaaatcctttagtctggcagagcaatgatatttcagcaccaaggacagaagtccttgttttagttgtgcaatagccatgattgtggcatgaaggtgacaagtgtcctggccatccttctaattctgtccaagctctggatgagctcgcgaggattcagctccctgattttgaagtttggcagttcctcagggcccctgctagccatttctctcaggcccacggtaggctgtgccccttctgggcctgagctggagtcaattgttattcctctatcctacagtagctggaagatcaagaatgcttgaggaattcattcctttagcagcactagagagcaccttcgatattccaggctctgctctatgcactgagaaaatggttttaaataaaatggacatcaccccgcccttctctctcttctaggcaagacaaaaagcgtaaataataacagctaccatttattgagcgtatactacattctaggctctgttctatgcacttaatatatattcttctgtttagaattcactgcaaccccatgagggctcattttacaaatgaaggaacagagacacagaaaggttaagtaaatttcccaagacccacacagctggtgagtggcaatgaggggaatcaagccttagtgtcaggctctgcattccacactctagccacaaggttctaataagtaagtagacatcgagaaatatgaaacacaaatataaaattacatgctatataggaacaaatatgggggtaatgatagaaaataaagagacagggacttaattagtggagatcattggggaaggcttcactgaggagcaggtggcatgcaagctcaaagagaaggaatcagtcctctaaggagttatggggaaggcctttatgagtgacagaaaattgaaagtgcaagggccctgtggctgccaaaggaagctacagggaagtcctcagcttcagaacctcacttcataggggccgacttgatctgattggtggaagggacataccacccacaagtccacgtggcttggatatggagggaaactccgcagtcagcacccttagggagtcagtgcagcatggtggttaagcaccctgacttcaggctgggcgtggtggctcacgcctgtaatcccagcactttgggaggccgaggcaggcggatcacttgagctcaagagtttgagaccagcctggacaacatggcgaaaccccatctctactgaaactacaaaaattagctaggcatggtggcacatgcctgtaatcccagctacctgggagactgagacacgagaatcgcttgtaccttgcaggtggaggttggagtgagctgagattgcactccagcctgggtgatggagcgagactctgtctcaaaaagaaaaataaaaagaaccccaactttggagtcactctgcttggcttcaagtctgtctcgccacctatgagctgtgtgttatttaatctttctagcctcagtgtccccatctggaaaatgggcacgatgatgatcgcatttatgtcatggggttgttgtagaaagagtgaatatctgtaaggtgcttaggataatcagtggcacatgtaccagttattattgctgccctgtgtggagaaagctgacttaggtttgacattcaaggatgatgattagttcaatgtcagaaaaggggagctagggaggcagctcagatgccatcccggcctccaataggagaatgctgcctctggcagatggggttcaggccagagaagagagagaaacttctctataccacttctgacctggggctggaatctacctgcctggctttcttatatttcccaaggagggcagaaaaagaagctcaagtagaaatgcagagtcagtggcctgaatcctgaggctggagtacctgggcttggtggctcacattcttcacagggctcacgtcactgaatcagcttgcatcgccaagcgtctaaaggtctgttgagggctaattggttttccacatttcatgtatttttgaaaacattgtttactgccttttttctgattataaaaggaatgcatagccttgatagatggtttggaacataaaaaaatgcaaagaagaaaataaaaatcatactctacctttcagagatgacactgggaatgtacttcccctctagtcttttgtctaacttctttgtgtattgtttggaaagaagaaaagttctaaagatgacctaaaaacacacgctgaggcccagggaggtatgtgtgtgcagttttgtgtgggtgcctacataatgccagactttattttgacgtggctgctataattggattaaataaagtgaacatgcaaacagtcatgaacgcatcggttgggtttaaggaaagcaaaagagaaatgcaatctgctttccctattggagatgagatattaatgatctccttgcatcagtcatggagctacaagttagccagaaacagagctcttctctcaataagcaagctggcaccaaaggccttcccgaatgcggatttgcctggaggaggttcctggccaggctctcgactgatttgccaacttttgtttaaacatttgcttgtttatacatcaaaggaggtttgggtctgatgattagttcaatgtcagaaaaggggagctagggaggcagctcagatgccatcccggcctccaataggagaatgctgcctctggcagatggggttcagaccagagaagagagagaaacttctctataccacttctgacctggggctggaatctacctgcctggctttcttatatttgaaatgatagctgtttctcttactatgctttgccttactttaagcataatacccataaatcatgggttggagtggctaattttataaattgttgtcgatacatataaggtcaatacctaactttcatcacatgcccacttataaagggcccaaaagaatctcccatgtccccagtggacatgagagttattgaacataagagttattgaacatttttgtaacatcttaattatgtgtatattatcatcaagattcttctcatatcaacaacaccatcattatcaccactactaccaccaccattgtgatcatcatcaacttaataggcgcaactaactgtccccaagggcttttccatatattaattcttgcaacaactctatgggattggtatgattatcctcattcccatcttacagatgagaaaactgatacacaggtaactcacgtaacttacccaaggtcacacactgtgagtgggtattagagttggcccgtgaatcttgacagtctggctccagagcctggattcttaactgctatgctatgtgctttatgtagcatcctatacaagaggccccttaatattctgctctaagccaactttattatttttagagacatgatctcgctttgtcacccaggctgcaatgcagtggtgcaagcctcaaactcctggccttaagcgatcctcctacatcagcctcccaggatgctgggattacaggtgtgagccactgtgcccggcctctaagctaactttaaatagcttcaactgttttctttcaatgtagccttattcgaagcataatatccataagtcatggttggagcagctaattttataaatttgttgatacacataagatcaatacctaactttcatagcatgcccacttataaaggacccaaaagaatcccccatgtcctggtggcacataaacacactttgcaaaatgctgaccctaggaagtaggggaaggacctaccctcacccatgcaaaaagataattctatttacattcagcaggattttctttcatctgcacacctcgagagcgtaaacctgcaggtcctctcaaatgcagtcactatggagtaataaaagaacacaggccttaaagtcagacggaaccaggttccatctcagctctgtcgttcactagctgtagggccttgagtaaggtaaagcgactctcaaacctcagctgtattcatttctgaaatggggtaacacctgctaaatgaaggtgaaatgagaaaatgtcctggaatgcgcccagcgtggggccttcctgtggccagtgaggatgctccatctccccaataccatgatcattatttgaattttataaagatggagaaacagaggcatggcctgtcgaagccatttgctgacatcccatggctgtggtatagaagagctggcatttcgacccaggtggctggactccagcatctatgctctggcacttcacacactgtgtcccagggctaacatgggggccctggtgaccctggatgaagtggagaaattagatcaaccagggaaggaaaagtctcagaaaaactccgattttcactttccagctccctggaagaggcctgtccccacacactgagacttgaacaggtttcagagatttgaaaaacttctctgatgctccctgagccaaggccagggacttgtagggatgtttccaaatacctgattattcaggctgagagtaaacatgcggccacctgcttctgcaagccctgctgaggctgcctgggaaaatgacaattgtgctacctgtcttgcaatgtatctagtgactttacttttggaggaaagcaaggagaaacagtgaacacaaccctccccttcatttaataacagaaacaatcaggaccaatttggcagctattagaatactagtttgcctttatgccatctcttcacagtgggagccagaagtccaaattggctgctaaaggttggagatgaagacagaaggtcaacattgctattaggagctacgtggaattaaaaaccgaggcaccccgtggcctattctgtatttcactgcttgcctttgttcatccccatctctctgtctttcaagatctctgcctctgtcacctcctcttttaccagggctggtctggacacatgaaataccagaatgggaagggaatttggagactttctcatgcaacccccttgtttttcaaagggagaaaatgaagtcaagagaagcagagtagctgcctcaaagtcaccagtgcattggaagaaagcaggcctagaacacagagaggcttcatcacgtgagaattatgagcttggactctgtgaacactcacttgggtgtgagtcctccccgctgccctagtgctgtgagtttgagcaagtaacttcatctttttgagtctcagttcccttatctataaaaggaggctaatatattgccaataatccccacccagtgccagaaaattaaacatacacacagaaaaacagaactaatagagagtctgggcctgatgatataatttgcacagcttgatttagccatacctgaagtcagccctaatgttttagttacctgatctggtaatgttctttacccttaagctagtttgagctgggtttctgtcatttcccaccaaaagagttctccctaacacatcaccagtgaaagaacttgagcaagccacgcccagctctggtcacttgggagggaccatggatgatgggctataggtaggcttattcgtgcagcaggtgaggccacagctaacaaagagggaagtggccagtgaatgggacattggcttgttttactattaaattaatgctgaatcactgccctaacttccggtaaatgagaaaatcccagctggggactcacacgcaagagttggaagttgtgagctattctgtcaagaggcctttgggttttagggtcttggagggaggtgtaagaagcatttcctcagcctgagacttctttatgttgtcccaagacatctgggtaccacctgtcaattacggatgcacatcaattatacaaaatgtactcaggcacctagaggcaaaattcaggcccattctccatctatttctttctcctaccagcaacaatttagttctatgcttatcataacaatgacataatcatcaccatcaccatcatcataaacatttactatgccaaatgctgtatatgcagcatctcatttaatcttctcaatgaataaatgagtataggtctattaatattttcaaatattatgaaaccagttcagagaggttaagtcactcgtccaatgcaacacagctagaacacagtagatcagaattccaaaccagaaggtgtaacctcacagtccctgtttttaacttgtgctatactcagttcctagcacagtgcctgacaaatagtgctcagagaataaatcctgactaggctgaaatagttaatactagggtggatgtaattcacacacaagttgatacatttacaatgggctcctttctcgagacacaactttgcacaaatcacctattagctgctacctggagaagaagaagggtttttccttctctacctgagggcgaggaataccaatgtctgagccacttctgacaattaaccacctccatggaatccttgcccagccccactttgctcctgcagctatggggccagaaaaacttgggttcaaattctagcatttaaccagctgtgtgatcttcagaaaaatcaggtaaactccagaagcttgacaaatggggagaataattcttacagctgcattgagtggctgtgaaaacaaatatggatcctatacaaaaagggcccacttagtaggaacacaatacacagtggccatgattcttcttactcatccagccaggcctctgtactcttagtggcctgagcgtagtaaactaatctgtgctaatttacagagcatcttcaagttcgggtgttgcagaaagaggcctcctttttaatgtaaagaaggtaggctgtgagtaggggcaggaacaatccataaatagcagaatgaaatcaaagtttcaatttagaaaaatgatacaacacaaggattctagggttacttttttttttttttctattttgagatggagtctccctctgtcacccaggctggagtgcagtggtacaatctccactcactgcaacctccgactcccaggatcaagcgattctcctgcctcagcctcccaagtagctgggattataggtgtgcaccaccacacccggctaatttttgtatttttagtagaaatggggttttaccatgttggccaggctggcctcgaactccagacctcaggtgatccgcctgcctcaccctcccaaagttctgggattacaggccttgagtcacggcacctggccagattacttctttaaagctcaggagacggagctacctgcttgcttttgttcctcccatgctgtggataactgggtaaactgtcacagagccagccaaaatgacactcccaccaacaacagcagtgaagatttaaagcagagattacaaacagagatgtggtcgggggccaggttggggaacggggacaggcaaggaccgagcgacctaagatccaggaaataactgccatgagaaaattcaggcacagacttaatggaccttcagattttttaagactggctagaaatctggattttcataggaaatactgctgtttttaaatggggctattaattttcaaatgaagcacctgaatgaaaacaagacaaaacaaaacactctgagagctaaaccatgcacgttaacaagctgaaatgatcccaagcactgccaggttcaatgctagaacaagaccccgggatgtcagagccaccctggactggtgtttaatggtgttttctttttttgttttcttttttagatggagtctcactctcttgcccagggtggagtgcagtggtgcaatcttggttcattgcaacctccgcctcccaggttcaagtgattctcctgtctcagcctcctgagtagctggaattacaggcatgtgccaccacacctggctaatttttgtatttttagtagagacagggttttaccatgttggtcaggctggtctcaaactcctgacctcatgatctgcccgcctcggcctcccaaagtgctgggattacaggcatgagccactgcgcctggcctttaatggtattttctattggaatgaggaatcccatcacgtgatgtcacctacagggggcgctcaatactgtatcccttccagttgatggaccatcatggagacttgggctcagctcaatgctgaactgcagagatgctatttttttgacattgttcattttaagcgagagaggtgtgagggatctgggttggggttctgggtgcctcccacccctgctgatgtgttggacaccagtgagggagtgaggaggacatggggctgggatcaggacccctgggttcaagtccatgctggtatgacactcttttccactacaggtcaattccctgagaggaaggacttggtcttgtttgcggctagaacagcaactggcacacgcccatgcttgttaagtatttgaatgagtggctgactgaatgaacgatctggggacgttgcttacattatgggcctcagtcttcccatcaataaaatgagaattaaccgtgggtgccctactgaaagggttgctgcaatgagatattggacttgtggaagtccttgggggaagtaatcaaaagggctgtcacaccatgagaaacatctatggttatcttgtccttggctgacagaagggactacttcagatcccacgcagacacagcgaaggacagctggtgccaagcctttctcccaccctcaacctttctgtggctgcatgaaaccagcctagaaaattccccaaatgatcactcagattttcatttccattttgtacaggggtaggggttgaggtgctaccttgcattgtcccggccgtgtgacttcaagaaattcatatctcggtatcgggagagaaacgccaccaactggtcatttgtcctgtggaaacaaaccaaggggagagtcaggccagacaccgtgggtactgtctttgtcacagaaagcaagtttcaccaattatgtcagtctgcttgaagcaccttctctgatcatttgcacacaggctgataaggcatcctctttatatcgccatttttatgtcaccatcactgactctatcacactatgttaaaatgggctgtttgtgcatttctctcctctatactccaatatactggagactctgtgagggcaagtgtggtgctccacatgtttgggaatctccagtgcctggcactgggcttggcaaacagcaagtcagcccaaagctaaatgcacagcaacctcaggacctttgcatttgcttgcctgggaaatttctcccagtattgctggcttggctttgtcatcaggtgtcctttcaaataccacctctttagagagaccttttctgaccacttaacctaaagtagtacctgcctcccgctctctccccacctttattacatcactctgtttataatacttcactcttgtatcaccagctgaaagcactgaccttgcttacattagaatgtaagttccacgaggacagagcccagctggatttgttcaacactggcatacagtaggagctatattaatatttgttgaataaacaaatgaatcaaagtgatgtgtgttcaaactgactccttcaaatgcactttgagcaatgaatgcatcaatgaatggacggataccaagtcctcgataaccacggggctactgattgagagagctttaaaaaatatgaagtccaatacaaacgagtgacatcgttgccagcattgttatcccaaatttatccccatcaatctcagcactagcagtgtaatcacagctaatccgcttgcgcatacagctgtgacagtattttaaaaggcagtcacacgggtctccatctgccagaaacgcagtcgcctcttctgctgaataaacccaaacaggtaaatggtgctgatgtgacagctcctttatcaccagccttctctgcttcggaatttttacttcaaaggaaagcgttaactattgtttcaaatgggaggaacagagaagagagcagaaagataaaaaaacatctctggggttataatagaagctagaccttcgagaagcaggacagtgctttagaaagcaatgcttgggcagaaacagaaagatctggggacagatcccagctccatgactgagtcagctgtgtgtccaaggatgtcatttaacctcactgaatggcagctttctctgaatgcgcctaggttgaaaattaaacatgcccagcacctagtaggcccatcatgcatatatactgaatggacaactgggtggatttaaagggcacacagtaggggcacaatcaatgcacgtcgtcctgctctgcctcccaactctttggtctgagctgcccctactgctcaccccctccttcatttccctgcgcctctgcagtctcgccactccaagcccctgttctctcattggatgactcatgttgaccaactcataattccagcggagggggcacaaagcagttaagagaggcagcagtgaaaatgagcgctgctcgtgtcccatcctattactgaaataaacaccaattcaaaaccagccattctagcagcggcaggcaccagaaacaccccgtgtgtctgcagggagttgaatacagcacacacacggaaagctaaaccttgctgatgggcacagaggtgaacccaggggatgctcgcaaagggctaaccccacgtgtccctacaatggtgcatctcccgcgtggttaaaccccatcgtgcatgccaaggtaaagtccactggtgcctccgacactgttacctgtagtttgtggggacagagcctctttaataagtcgctgggagaggtggaaactaaatcggcctataaaaaaatttaagcaatgtttctctccaaaccataaagaggcccattccaactgcgttttaacagctcttatttaccaaccccctcaccactctccgcaacagttcattattgttgtcctgatgaatacgagacaagttaacctctgaatgggtccccggcagttggaataataaataaggtctctcagacacccttagtgggaggattgaaggggccgggccggggctcctgggcccccttctcgtgaagcctcaggtctcccagggtcagcggctgcagttccatttggcaatcccagaaagcgcctttcagggctgtgagctggggccattttcacatttaccgcttcaccgagtccccatctgacggggatgaataggcatttagcgaatttacttagcgatgcttccacatgaaatcgtctcaaaagatgacatcttgggggagggagggtggatgaggagggggctgaggtttccaggcccagagcttttgggcaaagccgcctttcaaagccaagcgctgtgtgcttggcaaaggatcctgatggattgtctggaagggtggggcggggggacccctgcctaccccccttgctagggtctcgggcccctcgctctccctctgtgtgaaatgcttgctctgaatgctaaagcccatccccccagtccttctccaaagggagatggaatttggctgaggaccaaattctcctattgttgctttcagacgcctgtcgataattgcctacataatatttagttctctccagataattaacagcttgcgatctggtgacattttaccccgttccagtttctcgcgcgctctctctctctctctctctcttccactcacacacgtttctcactctctttttctggtgaagtcatttgccaaatggttcccatagttcatctcttgtatctatctcatcatcaatttcctcctactttttgctgaaatgattagaaatcatgtctcttggtctatgccagttcctctgcttcctgaggataactggggcctgttgctaccaccatgggagtcactgggaagtctctgctgaaataagtaagaaataaatgttaaaataaacttactgggagccatatgagaatctttttcgaaatgaataaaaaaatgagtaatacaataatctcccaagtcccagccatttactaaatgtgcaccatgccctaggccatggggaaagacttttgccacattttattgcatttgatagtcacaatgatgctaaaaaatgtaaattttggctgggtgtggtagctcatgcctgtaattccagcacttggggaggccgaggcaggtgggtcacttgaggtcaggagtttgagaccagcccggccaacatgatgaaaccctgtctctactaaaaatacaaacaaattagccaggtgtgggcatgtacacctgtagtcccagctactcaggaggctgaggctggagaattgcttgaacttgggaagtggaggttgcagtgaacacagatcgctccactccactccagcctgggtgaaagagtgagactctgtctcaaaaaaaaaaaaaaggaatttcacttcactctcattttacggacgggcaaccgagacttagataaatcatccatttagtaaagtgcagaaccagaactggaacctggggacaaatgtcacagcttgtgttctctactacgagactgcctctacaaatgatagtgaatgaacgagtgaatgaatgaatgaatgtattccatttcaagtgcagaagaaaaaaaatacaggcgcaataatgtcttcctcttcatagcctggtctgcagcccactgctattagaaatgccatacttcaggccccacccaatacctattgagcaacagagctcacccaatatctattgagcaaaaatgtgttttcaaacaagattccagatgatgcatgtgctctttaaaatttcagaagcattgctgtaagtcatgtatgactatgagtagttaattctctgctttccatctttatctgctcctcatggtttcttctggagaacccggactatgaatgaattactttcatttcaataagccttaggtcttgagagtattaaataaaaacaatgcacctaatatctgtgccacagtacttggcatatagtaatcccctgataaatgtcagctattatataatagcattattattaccatcttgaacatcagaagcttaagacaccttgaactgtggaaaacagtgtaaagacccaacctgatttgaacttggaaggctttctgtgcataagacccatggaatgttctgcagagcatagtttaagagatgtccaaggccccttcctggggatttgtccaaggtcccttcccagctggtgtcagacttagggactggctcccagagggccatggcaccattgtgtgtgtgtcttatctatataacagctctggacatgaagatatgaaggaagagagggcagagttctcaggttcccatagcacccaggagcccaggctgtatggaaaaggtgccctgggcacacagaggcacacaatgcctgtttgctggtggcatgtgacaagagatgaagcctgctcagcttccactaggaaggagcccaacacaaagccaactgcacctctctgggctcccggtgcccacctggcactcatgccccagaaccccttcccgactgcaggatactgtcaaggaccctgccagaggtgctcacagcccaacggtgaggtgacaggactaaagccaaagttatacgcaggattttgtgaatgtcaggattcaggatttcaaacctctgatgctgccaggtgtgcacagagcccaggggacactggagtaagtcctcctggactgcaatgaacgacccattgtggggcagaaacacacatgaaagactatggggaggccaggcatgcctgtaatcccagcactgtgggaggccaaggcgggtggatcatttgaggtcaggagttagagaccagcctgaccaacatggtgaaaccccgtctctactaaaaatacaaaaattagccaggtgtggtggcatgcgcctgtgatcccaggctgaggcaggagaatcgcttgaacccaggaggtggaggttgcagtgaggagagatcgcgccactgtactcccacctggaaaacaagagcgaaactctgtctcaaaaaaaaaaaaaaaaaaaaaaaaaaaaaaagaaagactatgctggtgcatgagggactgtgaagtcaggcaagttgaggaagttgagggttgaggtgctttcaacctaagctgagaatagactacaacagtgtttccccaacttctgcttctagtgtacccataatctttaagttatttcatatgtctatttaatttaaattctactttagctttatcttatgcaccaatgtttgtgatatttgatgtcacaaatttttttttttttttggagacagagtcttgccatcttaaccatttttctgagatcagacgaggttgggtgtgttcagggtgatatgtctgtagaccatcttaaccatttttcagtgtacagttcagtggtactggatggattcacattgttgtgcaaccatcaccaatatccatctccagaactcttttcatcttgcaaaactgacactctctacctgttaaataataattctctatttctctcttctatagcccctggcaacccccattctacttcctctctgctattttaactattctaggtacctgacataagtggaattgtacaggatttgtgttttgctggctgacttatttaactagcaccatgtcctccaggctcatccatattgtatcataccttagaatttctttcctttttaaggctgaataatactctctcatgtaccacctgtatgttatttttttccctgttacacattaaaaacattaacgaccacgtgtctgtatacttcttaaatcaactgggctaccagaggcacatatggaagaggtcaactgtcctggtttgcccaggactgagggagttcccacaacacaggacttttagttttaaaactggatggtcctgagcaaatgaagatgagctggtgaccccaggcacatggctccattgagggctgtgtaaccacaggagaagtgcacactccacagaggcaaaaatctcaccctcctgtgatcaacccaatgtatagaaaacaagataatggcagggcctattgtaaccttttcctatgcctttaaaatcattatgaaagcttagatcacagcaagataaagactgaaataccagcaatagcaacatcatcatcatctaacacttgaatgcctcctatgtggtatttgcatctattaacccacttaatcctcatgacaaccctaagaggtagatgctattatatttatatccatttgttattatataaacgggaacatgtatatacatggatttttgtgtaatgacctatgctgcttctctcactcatcagcacgtacaggcagacttcatccttttaacggttgcacaggatcctatagaatgggcgtagccagctgggcatggtggctcatgcctgtaatctcagcactttgggaggccaaggcaggcggatcatgaggtcaagagattgagaccatcctggccaacatggtgaaacctggtctctactaaaaatacaaaaaaaaaaaaattagccaggcatggtagtgggcgcctgtaatcccagctactcggaggctgaggcatgagaattgcttgaacctgggaggcggaggttgaagtgagccgagactgtgccattgcactccagcctgggtgacaagagtgaaactctgcctcaaaaaacaaacaaacaaaaagaatgggcatagccaatgccctagtgatggacacttaggtcatttccattttctcccccttacaactactgctccattgaacacccttgaataactatcttttcacatgtgggcatgataggtttctgtaggatcaaatttgcagatatggaattgttcactctaggattatttttcagtctttaatttcagaaagcaaactacacggaatgagacttctctaagaattgcccaagactcacatcattgcacagaaaccaagcctgtggctgccaggagcatggggaggaagaaggaaattgcaaaggtgatggagttgggatgtcttgcagagctggcaggctcttggctcctccagcaggctggtggggttaagcaggggccttctgggttccccaaaggaccaaccaccagcggaccctggaaaacaaaggaggctcacatggagatggaaaggaccttctgtcaagcaacggggtcagggcagaaccatcctctcccatgcctggagcagctgctgcagctggtgatcatctgtctgccaacagaaccagcatctggactatggggcagcacctcggacagtgcttttcaggaccatggctgtagtcctgggatgagcaggcattgagtccaattcccatctgttcctccaggacctgacacatagaaggtgctaagtaagtattcactgcttaatgcaagcccaagtagaggcccggtatgcagggttcatctctgtggcttctatgctcagcacagacagtacctgccccatgggaagggctcagtccatcattcacttttttttttttttgaggtagagtctcgctctgtcacccatgctggagtgcagtggcacgatctccgcttacagtaacctccacctcctgggttcgagagattctcctgcttcagcctcttgagtagctggaattataggcgtgcaccacaatgtccagctatttttttttttttttggtatttttagtagagatggggtttcgtcatgttggccaggctggtcctgacctcaggtgatctgcctgcctcagcctccaaagtgctgggaccacagacatgaggccctgtgcctggcccatcatccacttctgtatccacatctctgcccattccataccctctgccaggaatgctcctccctacgtctttgcccaatgaactggggggtgatttgggggaaggaatcccagagtcagggtactcatgagaaaatgcttcataataacaattgcagaaagatttccctttgttgctcaccaagtgttaagtgctcgtcctccttaattttacaatacacatccaggaggtactcatttgcggatgaataaactaggactggaagagccttcacagcttgtgccaggtcttatgagtggtggaggggagatgcagacctcagtgccccagggccagagcctgagctgttttcaatcccgctttccccgtggtgaataagcttcaggaatgtgatccatttctgtagacagaggcaggaaataaacaggaaactgcagctgccttctgaagcctactacttcccttcaaggggactgttgttgagtgcgagtcgcacaacaggaattgatacaggtagaacctctgttcagggtgtatgtctttttcctgtgctcctgtaaaatctgaagtccagtaagtttcctcctccccctgcctcatgaatggattctaacccatccttccatctcgtgaatggattctaacccatccttccatctcgtgaatgggttctaacccatccttccatctcgtgaatgggttctaacccatccttccatctcgtgaacggattctaacccatccttccatctcgtgaagggattctaacccatccttccatctcgtgaacggattctaacccatccttccatctcgtgaatggattctaacccatccttccatctcgtgaatggattctaacccatccttccatctcgtgaacggattctaacccatctttccatctcgtgaatggattctaacccatccttccatctcatgcatggattctaactcatccttccatctcgtgaatggattctaattcatccttccatctcatgcatggattctaactcatccttccatctcgtgcatggattctaacccatccttccatctcgtgaatggattctaaaccatctttccccacggcttatctgggggaggaggagacactgccagtgctctctcctccacactccagacggtttatgcaaggaccttactgacatcttctcacccactggaaaaatcagggaagtccagggttgcagaccaacagtgaataaaggccaagttcgggacttgctgaagaagagacaagagcaaaagaactggaaaaaaggcaaatccctgattcaaatgcagtcaaagcacatgcacttgtatgttcactgaagcactattaacaatagtaaagacatgggatcgatataggtgcccgttaatggtgaactggataaggaagatgcggtacatacacaccatggaacactgtgcagccatcaaaagaacaaaatcatgtcctttgctgcaatatggatgcagatggaggccactgtcctaagtgaattaacagaggaacagaaagctaaataccacatgttctcacttataagtgggagctaaaaattgggttctcacggacatgaaaatgggaacaaacactggggactactagagagggaagaggaggagggcaaaggctgaaaaataacctagtgggtacaatgctcacttacctaggtaatgggggccttcatacccaaaacctcagcatcacacaatatacccctggagcaaacctgcacacgtacccactgaatctaaaataaaaggtgacttttttttttaaagtttaaaaagtagtccaaatttacagagacttattttgctaagatacggaggaaaaggtatgaaaaatgctaaagagtatgttttcctggactccacaggcataattccagccaccatgagcaactgaggaaaagtgaactggataaaatgctggcccggcctccaggctcctctttacctcgtcctccaggaagcagctgcaggatcttcctaaaacatgagtctgaccatgtcaccctttgactcagtaccttcagcggctctccatcatctgaaggacaatgtccttaccccttggcaaggcatgcaaggttgtttgtgacccggcactgcctactcaatctttggaattacttgaagttttctaaatgttctgtgttctttcataactctaagactgtgcaagcactgtttggtctcctgggaaaaatatgacttccacttcttcaataggtcaggccctgtgacaaacgcctgggacaggagtgggtaagatggttgtggcacctgtcctcaaggaacgcacagaacactgggggatgcagacatataggtaggtccctgtgatatgaagtgagacagcagatgaattgaagcacgagcattcaggggaggctacaaaaagtatgctggggacaccagggggacagtacctccttctacaaaggcaggcagtaaactggagaactacctggttgttacaacccaatcagttttaattggatttacctttttgtactgacaaaaatgatgtggcattaaaacacactcattgtatttgaatggaccggcaaaccatttcacaaagcctcagtgctttcacaggacatttgtaagaaacacatttttcattttaaacatacatatgcctttctaagaggcagtttatctgatgttctatcaatgagaactcttaacacaccagcccttccttcagacggctgtaatggaaaggtaactgacaacaatcagcacccaggggccacgcaggaacccaggacgccaccggaatcatgaatgaactaaactgacattctgcttggtgggttggggggcgggcggggagggtggggatcgtgtgtgtgcacatatgtatatgaagtctatttaactgtattttgattctcttaagtctgcttgtcctcacatgccatgaggcatctcaaatgtgcacaacatttagttaaccaaattctgcattcccatacaatgattgattacagccagttatttgatttggtcttcagggaaccaggggaggtccacttcagagggcatcgaaagattgaatcttaaaagtaaatgcaatttaagtaggaaagccaagacacggctacaaggaaagctgttttcagagaggtgtttacagtagtttctctctgctccttgccactttcttgccgtttgatttttagcaagttcctcaggctcactgagccttggttttctaatctgccaaatgggagcatttaacaatggtctatgagttacttgtgtgttgtgggtatggtacatgcagtgcctggtgcatagcaggtgcgcagtaactggagttccttggaaagaagtttctatattcttcgctagaaatgcagagagaaaggcatgtccaccccttgctagtttcctaccaagctgtgacatttcaattcttacacacttgtggttcctagcaaaaatttaagttatgtatgttcaagttgcttgactgtaagctacctgaggacaagaactttatctgggtcatctatgttccccaactgtccagcacagaggccaggaacatgacaggttccatcagccttatgcctatttctctttgggtccccaggcccatttcactgtagcccacggaaactgctcagcacaactgtgttgcaggacagaatgagggcttttgtccataccatccctaatgccagaaacatccttcctacacctttgcctagagaactcctgcttgcctttgcaaaagctggctcaatgtcagttccactgggaaaggctggagtataaataaccattgaatggcactgaactgtactgacacgctgacctttctctttgtgcttatggctgagaacagatgcctttttcaccattcatcctgccctgggtttattcaaataatcaccatgacctataatactaatttgtccatttccatttcaccacataggtcttcctaacgcacctacactaatgtatcagaatttgcagtggttaaaataatgcagatctgacatcagagaaatgtaggtttgagtcctagttctactacttattggctgtgtggccttgggcaggtcatttttagctagtcgatgctcaattttgtcatttttaaaattgaggataataacactatttaccttatagagttgaagatgtaatgaaataagagggaataatctgttgcttgcaactacaaaattctagctgatacagaaactggtatcagaagtcgggtaatgagtgttgagccagtgaaaacaagagagatctagtacagcttaggtaacctagcccacagaatgctagaatgtcagatcttattattgttattatttttattatcatgaattctccaggactagagtctgcactgtgccaggagtaggatacagcaaggatctctaactcccagaactttgggactgggtcagtttggatttcagccccaaggtgagattgagcttgaaggacagttgatagtgtcaccaagcatctcattctccttgggcagcttgccacattcacctgcctgtctgtattggaacaaggtcaaaatgcactgcaacacaggcaagaagtcatacacaccatggaaaaacaaacactgtggtttctgcaacacagagatcgattctggaggatcaggacatgctgcgtccagtagactctttacccacagatttccaaggttacttgtttatctcagagggctgatgagaaatttcaaaaggatttttaaacggattttttctttttaaacagaggacacaggccttgaagtaacttgacagttcctaggcaaagaaaacttcagaaatgatttaaatgagacgttatcacatagatcatcggtttttaagctgcatctgggggaaccccaggttggggctgggcagctggggcctcaagacacctcagtagaggtttccttactgaggactcacttccacccctatattgggtaaaatttcaattgtgcaaaaatggtttagtagcctaaaaacaagtgttcaaaaatcatttaaaaaacggccaatttaacttccagttctcctttaggagaggaaggaggctggcatcttactcaatagcagaactggctgagctctgccctcactaactgcccaatcttgggcagatgacaatttttctgaacagcactgttgcctttataataacaggaatcgcaatatgacatgccttgtggagttgttttggggttagaaggaatgatatcaggttaacctgttagcatgggtactcggtgtacagtaaatacttagtaagtattaactatgttactcttgcagctgtgaattaaatttctttttattccctccttccttccctcctctctcccttttttttctctccctcttccatttctctttccttttcctttgtccttttctttcctttctcttcctgcatcctgcctactcaatctttggaattacttgaagttttctgaatgttttgtgctctttcataactctaagatcctgcaagctctattagctttcctggtaaatacaatttcccagttcttcagcaattcaggccctgccataagcatttgctgagcatcttcctatgtgccaaagactgcgttcatttcttttttttttttttttttttttgagacggagtctcgctcttgttgcccaggctggagtgcagtggcgtgatctcggctcactgcaacctctgcttcccaggttcaagcgattatcctgcctcagcctcctgagtagctgggattacaagcatccaccaccacatctggctaatttttgtactttttaatagagatggggttttgccatgttggccaggctggtctcaaactcctgacctcaggtgatccgcctgcctcagcctcccaaagtgctgggataacaggcgtgagccaccgcacctggccgactgtgttcatttctgacttgagacatgaattctgctttttcaacagctgggtatcactttgagttgtatgggcccatttcattgaggacatttaagcccgggttttatttgactctacatgagctcatacctcctgcttcttgggtaaaagctgttcatttacagatatttctttcttttcccagagaggtatttactcaggggcaataccttagtcctgctccttctgcgctcctatggtgactgatacagtgctttactaacaaacaaacaaacaaacaaaaaaaaccaaattagtaacaaatgtcatctgggatctgatcacataaactctgccgggaagatgctgacacaagttcattgctcgctgatgaattattttcagtgccaggtctctgagtatttaaatggctgcattgtaaaaacaggatcgtattataaattgtcaaacaggacgtgtagtagatgaaggcagatttgtgcacgccacactacctccacgtactcattcagcaaacatttatgttacagctactatgagtcacgtgctgtttcagatgctggagaaacagtgaagatgaagacaaaatccctctgagaatggagctttggtgttccgaggcatccacgtacatcctggattagcttccctctatgcattaagagcatactagtcacataccatccttgctagaatcaagaacacaggcactctgcccacttcctgtgttttgtggctcaaatgaggaacctcagttgagcaaggcttggctagcgccatgtctggcatattatagttgctcaatgcacacagggacaaaggttgaatgcaatctccgagtctgtgccaggttcctggaatggaattcacaaactcggacagaattcctttcatgctaaggcagatacatcagcaggtccagctgagacgagcctaactgagtgacagcttgacgtgctgctgttctgcagaatcatcattcggcaaaaggtgaaataggtttaaagatcatctctactccttaatccttgcggtaccaccttgcaggtttctttatccttctgagcctcaatttccttgtctaagttgagcaaagatttgatgagatcatgggtgtggaagactcaatccagtgcctgccacatagtaatcgcttgattatctggtagcccttgttttttatttggctctgagtgagggagaagggtggcaggcttccccaggctgcaatgtgcagtcatcaaaggttttctcagggaagctgtggtccttgggatgttgacgaacccaagagttagagaccaaaccaagaccaacctctctgtggttgttccctggctggccctccagagggtggccaaaaaaataaataaataaaacacaaaagaaagatatacatctacagaagctgaaattcctctgtttttctactttatcttattacttcttccctttttctctaaagtagctgaaccacatatgttaagagtcattgtaatactgaaaagaatggaaaacaggtgttcgaacaaaacttggccatgctattcatggcagcactactcacaatagcccaaagtagtaacagcccaaatgtccatcacctgctgaatggataaagccaaatgaggtctatccagacaatgggatattagtcagccatagaaagagatgaagtactgatacaagctacaatgcagatgaaccttgaaaacataatgctaagtgaaagaagccagacgtgaaatacccacatgatgtatgattccatttatatgaaatattcagagttggcaaatccacagaaacagaaagcagaccgggggttgccaggggttgggggtcagaggggaatgaggagtgactgcttaatgggtacaggttttccttctggggtaactaaaatgcttgtaactagatagtgattatgctcatataccattgtgaatgtattaagcgccactaatttcagttgtatattatttttggcatattaaatataacttgttttttgagatgaagcctcactctgttgcccagggtagagtgcactggtgcgatctccgctcactgcaacctccacctcctgggttgaagcgattctcttgcctcagcctctcaagtagctgggattacagacatgcaccaccacatctggctaattttttgtatttttagtagagacaggctttcatcatgttggccaggctggtctcgaattcctgacctcaagttaccgccctctttggcctcccaaattgctgggattacaggtgtgtgccaccacatccagccaacatattttaatgttattatttatgtttttatttttatgccacaataaaaatatgacagttgaaccccaaaatttcaaactgagaaataaaacaacagctacaataataaccatgtttggtgtatcctacctattttatatacgctatccacctaatcctcacaacccccctaaaataggcagcagtagctccattttacaatggagcaaacttctcaaaacttgggcaacgtgtctaataatcatgatgatcataacaataataagtatagaatataagagttgcttgctgaggcacttgttacatatcggctcagtttgccttcccaacatcatcatgatgtacatattatcattatcacccattttacagaggaagatgaacagagaggttaagtgacttggcctaggttagacagcccacaggtaacagaaacagggatttgcacccaggtcatttgacctcagagtccatatgcatcaccactggagcccgcaggcgtggtcatggagccgggaaggaatgtggacacctgcagaacttacctccctgtcctctctcatggaaaatgggaacagactaggtatctgctccatgacatcaagtgacttcatgggatccagaccttcccccaggctgcatggaagccagcatatagccagacaggtgtgatatgtgaatgtccctctggcctgccaggctcccagacacagatccttgatatctgtgcaggcacctccactttatgtggagaagcagctgagccaaccttaggattcatgagtacctaccacagctcactgtccttttgaaataaactctccagctctttggaatgttttctgttttcatggtggtgaaatctgaaaacgtctctaggtgaaaagacattaagtaaagacaaaacccctccactggtcctcaatctaggaataagcccagagatgtttttaataaatggggaatgcaaaaaaaaaatgcggtaaaatatcagtgactctcctggcacttagaaataaaggaccacagccactgcagccacagtggtgttatatgggacaaacactgagcactcatttgctccttcatgccttacttcagtaagtacttactgagctctcactatgtgccaggcactgtaccaggaataagacacagtggtgagcaaaacagatgtcatctctccacttgtggaactgtcacccgggcagcttgggtcaccatcactatcatcgtttctcgagccctttctctgggtcaggcaaggtgctacacatttcacagcttcatccttacagtaaaggctgaggcaggtaactgatggttcccattttacagatgagaaaactgaggcagagacaggttgagcaacatgcccaagggcacgtggccagtaaacagaacagctggaaattgaactcaggctctgctgcctcctcaagtgcacactttcaaccgctttgctgcactggcctgagggcctgagccctggaaaattcctgccgactagcagaaggaggtttgtaggtccagttccagatccagcttacagggtctctccaggaaacccagggccacgaagcctaagaataaggtatgctgcagaaaagctcaacaccaagagaaaataatagcaacaaagcaacaggaggcatttagcctggtggaaagtaattacctgagctataatgtacatatctactagcaaaaaatactagctatcatgtttcccctcctccagcaggctggtacagtcctctactttttttttttttttaactttctttttcccactgccaagcaactgattataaactgaaccaatctcatcatggcattttctaatagaaaacttttcaaaggcttcccattgcttataggataagcttggactccttaacctggctctaaaggtcccacacggtctggcccccacctgcctctctggcctcattctattggcttatccccttgccacactctgtccacataagcctcttttcatttaccacagaagccatgttttctcctgcctcagtgcctttgtgcatgcagcccctgctgcttgcaatgttcaccgccccctttttttcacccagttaattcctcctcttctttcaactctcaggaaaccactgggcagagggcactccagcctgctgcccatctccttcttagttttacataaaaggagggggaactgatggtaggattacttagtgccagtgagattgcttgagacgtggttatgggatgggtacttctccagggaagctttccctggtcctttagaagagaaggggtgatatgcatgtctgtttcctgcattatatgcatgcaaatttctttcctgacaatgtcatgaagatgtcattatttgatggcttaatctgtatattcctcaaaggcagcgatgttaatggttctattggtgtctgtaaccccaggtcctggcaaatgtctggcacacagtaggtttccaacaagcatctgttgactgactagaatgtatgaatgaatgaacaaattcacagtgacgccctacagctgatagttcattaaaatgtattttgcggacaccaccttggttaaaaatctctctcttcctgaattaacattgcaacctgagacagacttccaagataaattacaggaggggagcccagacacatccaggcagtgagtcagtagaaaaccagacacacaagatcaactggatttatagaaagtactagaggaacacatgtccagtcactctgggaaatctttgagaattagctggcattaaggcattagtcagcaacttgcctggtcaaccaaggaaagataaacgagctctgtgcttttagcgggggagcagaaacttggggtaagtgctgaaatcaacgagtctcaggattcaatgacattaacctttttgattcagattgaggaaggtggtgcagggtgaattacggtgctaatgaggaccaggtatttatcctgcgtttaggcagagaaggctgggtggtaagaaaaccggtatgctctggctggcaggaactctgcggggctggatagccatggaggactgtctgtgtgcaaactgcctgtctcctctcggccgcccctggtcaggcaacactgatgggtgagctgtgtttcatgtgctccttaccagctcaaggtcagaaatggcacacgaagtaggttaggggaacataaaataaagggagcctgctgtttaataaggggttcagctacccaggactgggtagaaatccaggtcaaggcctaggggaggtagagcagaaggccttggggatctccatcactcattctctatccagggtcctgaagtctgaagcacttgaggtgattcagattcaaccccacctgggttgacagaatcatctaagatagtgaagcaaaggccatgcctaggaagatgggtgagtgggttggcactaaatttgaaagggctgagatgtacgtgttctgggcaaggccacgatctgaaacatgggagatctggcagaatgatcaagtgcaaactattgcctgccacctgtttttagaaagaaaattttactggaacacagtcatacccattcatttacatactgtctatggccgccttagtattacaacagcagagtttcgtcatcctgagagacatatatgtaccacaaaacctaaaatatttactatctggccttttaataaaaacttttgaggctgggcgtggtggctcatgcctgtaatcccagaactttgtgagctcgaggcaggcagatggcttgagcccaggagtttgagactagcctgggcaacatggcaaaaccctgtctctacaaaaatacaaaaattatccaagtgtggtgacatgagcctgtaatcccagctactcaggaggctgagatgggaggaccacttgagcctgggaggtcagggcttcagtgagctgtgactgtgccactgcactccagccagggtgacagaatgagaccctgtctcaaaaaaaaaaaaaaagtttgttgaatgaacggagctggaggcttttatcctaagtgaactaacaaaggaagagaaaaccaaatacatattctcgcttgtaagggggagctaaacattgagtacacacggaaacaaagaagggaagggtagacaccagggtctccttgaggaggcagggagggtgaggatcgaaaaactatcaggtactccatttatcacctgaatgatgcagtaatttgtacaccaaacccccaggacacacaatttacctatgtaacacacctgcacatgtacccctgaacctcaaataaaagctagaaaagaagtttgttgatccctcgcctgataactctcttttttgggtcattcacaatcttcctcataactttctggcatatccgtctaatcgaagtgtcttcctgacccaccctatcctctttccatgcaatagttttcctggtactcatttctacctgatatatgacccgctcacttatctactgtctctttctctaatgagcatggaggatgcacaacagtgcttgctttctttactgccatattcccaacccccagcaaaatggctggagtataccaggcactcaataagtacttgccaaatgactgaagagccacttaccccttgtattgttgccttgttaatattttctcatttaaatcaactttcattttatttatttatttactttttatttttaaggaaacttcagcttccaaaatctgggctgaacatgttcctattcccttctatgtgttaatatagataaacatggacattttcaaagactcgcctgcatttctctttaaatcatcttacatactgcaagcggcccacaggccatacttgggaagtcctgactcattgttaaggacatgggtgggtttaagctccactgagctccacttctgggtagctgagcatctgctcaagtcccttctcttgcaaatggggacaatgaaggtcccatctcaccagatggctgagagattaaaggagaacatagaagaagcacttagcacctgcagaaactcagtggcagggaactctcaggggtggggccatctcccggtcgctcagttcatgacaaagcagtgcccccttggtactgcagccatcactgtcatgaagcctgtctgagacactgccccaattcctgaatggttgcaccacaacccagcaaagcaatttggattaatgggactatttagctgtaggtgtccagagaatgcattgtttaaagtaacttgttggaaacttccccagggtggcaaattttaaacaaagattgactctgtaatcaaaaattgcttctgcttggccttaaaccagattccggcatcctgaagagcatgattagactgagaaagggtggcaatgtttgtgcccctggctcggtttgccaagtaatgttgactgatgaatacaattaaattgcactgaggagaatccctccctggaggagaaaggacataggagacgggtgatggcttttaggggcacagtttttcattccttctccataagggaacaaccaccattgtgggattccccttcaccccctaccatgggaaaactggccagtactaccaaatggccttccccttcccattctccacttttggattaactggtcttataggcagtgggccaagactagattccaggttctagagacactccatctgaccttcatgggcctgcttcacctaagctgagtgggagtgggaggaggcagcaggggagtctcatgaaccatgaagactttgctctctgcgttggcttctgttccatgatgatttcctaggaagctgacctgcccagatgtccaaatcactttctgatattgcctggggccaccaggggagggtcagaggcaggccacttgagcatggggatggggtgagggttggtgaggctgggaattggaaggaagtttcccacttgaaatttcaggtagattgcagttgcattcaaaaagtaactggagaaatgcacttgatttttcaaagtaagtggagaaatggacttgagaaatggaatatgttgtttcacctcattggggtagagaaggccagtaaacactagggctgtcttcaaacagccttgcagcagggagggaatatgggggcccaactacaggcaaagaaggctcagctcaaggcaactaccttcctcactctcatcacgatcagacttcctcaaaggcaggtgccccctgcccaatctgcatttctgtattagtacaaggaatagagacataaaatataagaggaagaaagaaggagagaataaggaaagtgaccacacaaggccagaccatgtttttgtccagaattaataactatacaggattattaattatcattgtcatcactaccattatcatcaaaaaatttccttgttaaaaaatgcccaattccggattaggtcctgtgttccactatctttcatgtttctaacaatcctatgaggaaagtaccctggggagggcactctagcctgctgcccatagcaggttctcctctgcccatctctctcctacatttacccaaagggaggaactgagggtaggattacttagtgctggagagattgcttgagacatggttattagtgggctagatatctgttctgtgaacccttcctcctcccaaatgaattgcacttcttttttttttaatgtttcttgcctcaggcctgggtggtacttaagcctcttggggccacgatgagttaccccaaccgcttgatgcaacggggtgggtacagtaagctaaggtctccctggtggattcaaccatctctccttgctttgtatccatcagtatgaccaagcatcctggtcccaatgttttgatggtgagaaggtggagaggaggtcacatggagctgccagacctgagccaccatgctctgacctagctgtcatcaaacagcttgaaataaagcagtacctggagtcccacctggctattcttccttttaccgctccctgatgggtagcatggtcatgccctctcacaggtgagaaaaaggagactcacaaaggttggatttgttgcttgagagcatatagctctcatacaggggatgaggacaggtaccttggtctgtacaggctgctataacaagacaccataactgggtgggttaaacaatggagatttatttactcacagttctggagactggaaagtccaaagtgcctgtcaattagatgctggtgaggcctctcttcctggcttgcagaaggccaccttcttgctctgtccttacatggcagagaaagagagagcgagctctctggtgtctcttataaagaaggacactccttctataggatcagggctccatgcttatgatctcattttaccttaagtacctccttataggccctatctccaagtacaagggttagagcttcgacatataaattttagtggggcacggttcaatctatagcaacaggattcaaatccaggtcaggctgatattgcatggcctcttctacatcgtagtggaatgacttgatggtgtagaatatgccagcattgctttgagtttgctttgattttgctttgaaacaattaggcatatgtggggggtggggtggggggagggacagaagccattcctttctaattatgcttgcattaggctaatatttaaatgaatgagaattccactgggcaccaccagatagccagttagggtagagatatggagagtctgaggtccaatgggaacaggattacaaaggaatttgaaggttggggttgttcttgctaacgcaggacagatggttcctaggtctatgcttagagcacacagtcagtaaagcttggatattccattagagaaagaaagagaccatctggagatgggtctacactggcttttggctttggcagccacatcgtagtgttggcatccttgggtgatcggctttccctccctggggtcaaccacttacacaacacactgcataaagcatggtgaacttcagggtcagctaagcctgcattcaaatcccagcttggccacgatcaagtcatgtgacgttgggcaagtcacttgaacactctgagtcctggtgctgttctatatgtcatcttactgggatgccatggggactaaagcagaaagtgggggcaacttggcagttggctaaacattaggtcactctggatctcaggttctgatgtaccctgctcatctcttgatacgtggacaactctgcctcctggattctcatccagatacagaaaccaaggatttagatggggaagaaatgagtgagagagctttaccccagaactatccagcaggtgaaattatgacccgttggcaaaaaactcaggtcctttcctctctgcccctactccccgtgatgaaagaagcatgcatttaaatcctggctccaacccccaccagttgtgagacactgagaaaatccctttacttctcacagccttggtttcttcatactgcgatgcagtaacactatctaccttctgggattgttgtgagaattacatgagataatgcatggaaatcacttggcctagaatcctatgcacagtaagtagtcaagaaatgtcagcaaatatgattagctactggagtatggcaggtcttaaaaggctttcccaggcatctactttgagtggctactattgaccatgctggacaatgactcagggtgggagcaagggagagaaaatacttgaatgataataagaataatccacagagtccgtctgtgtgcctaatgatcagaccttaaccctgtcgcttggatcctatactcagtcaaatctttgccctcatcaatttttaaaagggtagaaacgctcctcccttatcccacttttaatacatgcggttcctccagattgcccttgaaaagaatcttcacctgcagttagatgtaaggaacaggcaagggaagaataatagactctacaataaagaccacccacattgtagaccaccccgggctcacatccaaattcccaggatgcacttggagcatcccagcatggataccgtccatactcttggccaccggagaaaaagtcacataaaagacggcttttttttttttttttttttgccaataagcaaaaatgctcaatgcactgggcaggaagatgccagggttggaaacgtcccatccacagacacatagagagccgctgccaagaggaaggagaattgtgagatctggagagggagggattcggaagaaaatacattgcaaaattcattgtgtggtcaagctgggatctggtgagaatatcaaattggcagaggacagagaccacatttatttctgtactatttagcctggactctcttttcttctggtaacagtagtataattctctctagtggaagtgtttgtaccccatggcatcgatgtaaggttcatgagcgcacagttttaatttaactttaaattaaaatcatatcaaattgaaaatttagttcctcagtcccacaaggcacgtttcaagctctcaatggccacctgtggctaacggctaccatacaggatggtgcttatagaacatttccatcacccccgaaagttccactggacagtgctggtctagagcattgcctaatatctagcagaatctcaatgagcatctatttaatgaatggatgaatggccaagtgctctattctctgctagccaaagaagggatacacaactcaagagagaactatcacatttttccccaggactctgaattttttttgttttccgttgtgaaagaaagagaaagcaaacaaaatagcaagcaaacaaacaatacaactaaaagttatttaagccagatgatggcatcccttgggtgaagcagtcacttcaattcttgtcttccaccacatccttcccagaaggtcctaagcccatagaccactcttggctttctgcagaaccttggttttcatgagatctccgagaactctaggctcactctgtttgtccagccgatggtctaggtcacttctggccttaagaaggcttaaagagctgaccagcctaaaatacagctcaggagacccaggacaactggcaagagggaagcaaactgcatttctgcaaaagcaggagtgtgtgctccatcagcctgaaaaataacagggctgaggatatgtttattttgtgactagaggcaaacaaaactgttaacggcataattactggcatgtttttccagtctccttgtgaacaacagtccgagcagatacaccctttcaaactcacacattatctgggtggaggttttattggatggtttcgaacccaggaactttggggtctcaggaagcagagtgtgtgtctctgaacgtcccaaagaacaaaagtggtttggatgctgagaaagcagaatgcaggggagatggtcacacccaaatatctgagtgttgggccaccaagtatgctttcccacgaagtactgaggctaacattttccaacacagcatgtagcttctatttatttttctaactatgtgaaagatgtctctctctctccctggaccagtggatttcaattctcactagtacaatcacctgcagggtgctggacactttaaaaatatatagattcttggctgggtgcagtggctcacacctgtaatcctagcactttgggaggctgaggtgcgcagatcacttgaggtcatgagtttgaggtcagcttagacaacaaggtgaaaccttgtctctactaaaaatacaaaaatcagccagatgtggtggagagtgcctgtaatcccaggtacttgggaggctgaagcaggagaatcacttgaactgggaggtggaagttgtaatgagctgagattgtaccacactccagcctgggtgacagagtgaagactctatctcaaatatctcaaatatatatatacacagagagagagagagaaattgattcttggcatccacaaggaatttacattcagttgatctggaacggaactctagatttcttttttatttttattttttaagacggaatttcactcttgctgcccaggctggagtgcagtggcgcgatctcggctcactgcaacctccacctcctgggttcaagcgattctcctgcctcagcctcccgagtatctgggattacaggcatgtgccaccatacccagctaattttgtatttttagtaaagacggggtttcaccatgttggtcaggctggtctcaaactcctcacctcaggtgatctgcctgccttggcctcccaaagggctgggattacagacgtgagccaccatgcccagccgatttctttattttgagcctcccaagtatctggcgttacaggggtgcaccaccacacctggttaatttttttttttttttttttagaaatgggggtcttgctttgttgcccaagctggtcttgaactcctgggatcaagtgatcctcccacctcggcctctcaaagtgctgggataggcatgagccactgcgcctgctgaactctgaatttctgagaatcacatagaaccttgatttgacccggctgagaagcacatagtgagatgtcaagctccttgtggcagggatggtgtctgtcctgctccctgcggaacacccatagcctgacgcatgacgggtgctcaggaaatggccttgagaagcagctctatcctgttttaagagtctggctcagcctgtcttctcctgggagaccttggagtccccgtcagagcacacctgtgctaatattgcaggtgtaaggtgaagagggtctgacctgggtggggatgaagggcatcacagatggggatgaacacggagagatgtcagggttagaacgagaatacgcaaggtgcagatggagcagcaaggaagggggcacacaggcttccagctgcaggtgctcaggaggagggtggtcctattcagagaaatgggggaaccagaagggtgactgatataggataggaagacattttggattcttctaaaatgtagaagaatcagtccaggtgtggtggctcatgcctgtaatcccaggactttgggaggccgaggtgggcagatcacttgaggccaggagttcgagaccagcctggccaacaaggcaaaaccctgtctctactaaaaagacaaaaaaattagccaggcatggtggcacgtgcctgtaatcccagctactcgggaggctgaagcaggagattcccttgaaccagggaggcggagcttgcaatgagccgagatcacgccattgcactccagcctgggtgacagagcaagactcagtttcaaaaaaaaaaaaaaaaaaaaaaaattagccagatgtggtggtgcataactgtaatcctagctacttgggaggctgagggatgagaatcacttgaacctgggaggcaaaggttagagtgagccaagatcgcaccactgtactctagcctgggtgacagagccaaacgctgtctcaaaaaaaaaaaaaaaaaaaaaagaaagattaaaaaggtcaattttattttaagtgtattttatcacttttcttttctttcttcttattttctttttgggatggagttttggtcttgttgcccaggctggagtacaatggcgtgatctcagtccactgcaacctccgcctcccaggttcaagcaattctcacttattttatcattctcaccatattttatcactttaaaaaaaaagaacaaaagacaaagaggggtctccaccatattctttctcacattcactcaacccacattcttcctctaatcctctggctgcgcccctgttggcttatgattggcttttttctgacccgctctcctaagatccttgcatctcacgcttgcttctctgttctctgctccagctcctgttgaaatcctctgagtctcctgaacgaggctgttttgcacaggtgtggggtcctggtccccaaacagaaggtggctgcctggctctgagtgactaaaagacttcatggctgcttgggttcaggaagctccttatggcttccttctaggacacctgcttctgcctggaggtttggagaatagggggctctgtggatgtggctctggggtcagtagaagcaactgcttgtgatctggcctccccactcccatttgggccccactcccaactattctcccacggcagccagtacgatctctcaatgtggcaaatattgtcactctcccctaaaacctcaccgctcacagactgaggctttagtgacccaacaggacatctcaagtgcccacatgggcttgcctcgacctacctcatttgtaagaaggcaaaccctcgcctcttatgtttcacccatagttgccttctttcagatcctcagatatgccagggtcccaagctaccccctcttcctgggatgcctgcttggaacctcctcacacttctcctaaactcctacccagcatctacatctcagttcacaggctgcctcctcagggaagccatccgggccctcagtccatgtgagattcctttgcaaagtgctcatagatccttcattcctttttttcacaatgcttgcctgactttgtcatatgtgcactcctgtgatctctgtgattaatgtctgtctccttcctctattaataaccatggctatcacatggataaccctcactgtgtgctaagcacttcacatatatggactcacttagccctcaaagcaaccctatggggtggtgccattattatgcccattttacagatgaagtaactgaagcacagggactgctgtgtgcaacttcacacagctagtaaataaagaagctgcgatttggacccaggtggactggctccagcctgtacccttgaccactacgatgagggcagggctggatatgtttttcctcacctttgagttgctgcttagcacagtgtccaacacatagtaggtgctcaataaatatttttttgggtgaatgggtaaagtcagaaggagccctgtctcctgaactcatctgtgggagtagagaagtatcttcactgggctgacctaagcactttcctcctcaaagcaccccaagattgtcatcagaaggggcttggtgttgagagaaggaagaagggaaaaagggaagcttggacctcacactctactcctccacatttccatcttcaacctgaatcttccccggacaatgagaatcactgaagtttctttcccgttcagctgaggtccaggggctagcatgggtagagaagatccggtgtgaatgggaaaggccatcaggccaatatgctcagatctacaaccccccatggccaaacagtcaccagggcttgcttaacaagagtcctccagcaccactgctgggcagagtcccatatgatggagctgcatcttcttaaaccagatgaggtcctcaattcagggcatacagtgcagatacaacatggccaggagacaggggctttgggaagcttcagaatgctgagtatattgactgataattggataaacagattgtggtacaagtatatcaacatgatagaatatcagccataaaaaggaatgaagtgctgccacatgctacgatgcagatgaacctcaacgatattaagctaagtgaaataagcaggtcaccaaatgtcatatactatgtaactgcattcatataaaatgtccagaataggctgggcatagtggcttacacctgtaatctcagcactttgggaggctgaggtgggtagatcacatgaggtcaggagttcgagaccagactgaccaacatggtgaaaccccatctctactaaaaatacaaaattagccaggtgtggtggtgcatgcctgtaattacagctacctgggaggcagagccaggagaatctcttgaacttgggaggcagaggttgcagtgagccaagatcgtgccattgcactccagcctgggcaacaagaggggaggctccatctcaaaataaataaataaaaatgtcaagaataggcaaatcaagtccatagatacagaaaggagattagtggttgccagagactgaggagaggtttctgggaagtgactgcttaatgggtacagggttttcttttgggatgatgaaaatgtttaggattagagagcgtacggttgcctgacactgtgaatgtactgaatgccattcaacaattcaaagtggttaattttatgttatataaatttcacctcagtttctttttattattatactttaagttttcaggtacatgtgcacaacatgcaggtttgttacatatgtatacatgtgccatgttggtgtgctgcatccattaacttgtcaattacattaggtatatctcctaatgctatccctcccccctccccccaccccacaacagtccccggtgtgtgatgttccccaccctgtgtccaagtgttctcattgttcagttcccacctatgagtgagaacatgtggtgttcggttttttgtccttgcgatagtttgccaaggatgatggtttccaccttcatccatgtccctacaaaggacatgaactcatccttttttatggctgcatagtattccatggtgtatatgtgccacattttcttaatccagtctatcattgatggacatttggattggttccaagtctttgctcttgtgaacagtgccacaataaatatacatgtgcatgtgtctttaaagcagcatgatttataatcctttaggtatacacccagtaatgggatggttaattttatgttatataaatttcacctcagtttcaaaaaaaaaggatcatgattctacagtttactggctgtagccttggggtcaagtttcttaacatctctgtgcctcagtttattcatctgaaaaatggggatatcaagagtgcatacttcagagttgttgtcaaaacgatgtaaacaagcttgtccaaccctgccttatttggttgttctgttttgtttttttgttttaggcttttagcagcctgaagccatggtttttagtttctgtctctagtgataagcagaaaagagggatgaggaaggggctttactggcccaaccaagaaaagaaactgaggagccataactgtattctctccctcagacatccctgaattgtaaagcacttagaataatgctaggaatgtacgaagtgctacatatacatttgctgtggttgctgtgcggtcttaactacaggaattctttgacctattcgggttccactttagcagactaaagggatgtgatctgtacgcagatgcagtgactgtacatggatgcttggacttccatactgctcatcttcatttcaaatcccagagtgactgggatctgtgctgaacattatcaagggcttgacttccctgcaaagcttcctctgctctgtgttaatactaatttctctaaacttacttaccaagtagcagttgtgttttgggggatgggattaagaagaaatatgtggtaaagggccctgaagagggcccagcacacagtaggtgtgcagtaagtgtctgctctgttagtctgggggttagtcttgctcaattggtcccatataaactctggtcttcgggagactgtagagaagccctggccacctgttcctgtctttaccagctggtgtttcctactgaggcgccatggagcagctctctcatgttctcagcctgcggctctggtagtatctcaagacagacatttggatctgcagttaatgtaacttacatgtccatgtggtgggccctgatagtttggactttgttgatgtggatacccaagaggcagaagtagcaggaaaatgtcaacatggtttcccctgcctggtttctgtatacatacactgccccacatgtgcaaacgtgtgtacacaccacagactgaatgtgaaccccgggaggggccaaggacacactcaaccctcctctctttacatctgatttgccccaagacaccggacttaggaaaagacacagtgtgaggcgtgaggtctctctctctctcttttttttttttttttttttttttagatggagtttcactcctgctgcccgggctggagtgcaatgtcatgatctcagctctctaccacctctgcctcctgggttcaagtgattctcctgtctcagcctcccaagtagctgggattacaggcgcccgccaccacacccagctactttttgtatttttagtagagatggggttttaccatatcggccaggctggtctcagactcctgacctcaggtgatccacccatcttggcctcccaaagtgctggtggcattacaggcatgagccaccacacccagccgaggtctcttactacaagtccaagccaagaaacagggcaaagtgctattggcttcatctcttcctgcagccaatctaaagtaggccaggtataattccttgcctcggtaaatagaacatacgaataaaaccatcatacctttcgaggattcaagatctagcagggcctcagagtttgaaagtatccattttccactttcatccacgtgctgggtacacaaccagctccagctggagcctacgtggaccaggatgtcatgtcaacagcagagcaggagcacctagagtctctaaacactctcagcttgcgtatgccaagttcaggaatattcttcatgtccacaagtgaattggatctattctgtttttcttgaaacagtctcacgtctatctttgcttttcccaccctttttttttttttttttttttttagacagcgtctcagtctgtcacccaggctggagcgcggtggtacgatctcggctcattgcagcctctgcctcccgagttcaagtgagtctcatgcctcagcctcatgagtagctggggttacaggtatgcacaaccatgcctggctaatttttgtatttttagttgagtcggggtttcatcatgttggccaggctggtctcgaacccctaacctcaagtgatccacctgccttggcctcccaaagtcctgggattacagttgtgtgccaccgtgcttggcccacttttccctcttttgacagagatgtgagttcaagaaatactttgctactcttttaactctatcaaagagaaaagggaaagtaactcaagtcccacagttacttatagccatggagtaatttgggcatttatcaaccactttctgtcattagacgctgtggtaggtccttatcatgcaagatttcattgaaacttcctaagaaccctccgaaataggcactaatattgtgtttattttaaggtagagaatttgagatgcagaaagttgaagcaacttgcccagttggtggtggggcagaatctgaaaccaggatgtctgcgtccagggcctaaacaaggctagtgaccagtaaacaccagtgcatctttaatatctaagagaggaagaatctgcccacacccccccaccccccacagtgagggttgtgcaggggacacagggaggtgacgtcaaatcacagagcagctcacagtggctacgtcgggctggctggacccttaagtatcccccaagttttcagtgcctcttagaagtgcctgacttgggcactaccgcccctttgagaagactcctaagtttgctcattctttctgggatgggagaagtagtggttttggaagctacagatggggcggcagatggaaactgaaaacctatcagcattgcccaggatgaaaccattcatctgcaaaattcatatgtttttgtgtagggcaacttcatgaaaacaacagcaagaggaaccagcagtgcttgatgcataaagtgcctctggctatgaggctggcaaagaagagtgggcaaaggaattcgtgggaggcaccatggaaatgagatcagtgaagtagaggaagatgatgagaaaggccaagagacacagagtgacctggggcactaaagcaaaaaagccacaaataagacaactctcttttctgaaccccaaaataggttgcacgcatggcctgagaaaggatttctgggcctctcagagatacaagatgagaccttggatgtaccttacgtataaatggctgacattcatggagcaccttccaagtgtccggcaggctgctaggttctattattgtatcctgatttcacagaaattggatttacttgcccgcggtcacgctgctagctaagtggcagaactcagattcgagccgtaagcagtttgacgagagtgcaggcactcaccctcccgggtgctgagccgagctggactctttaggggaggtggccacgcaaagcaagccaacaatggcctctagggggcagcaatgcgcatgcctacctggcctcaagtggtcttgggcttaatgcgggcccccaacctaggctggcatgacctctgaggcctccactgggaatccagagaaggaagaatgtgggaactttgagcacagcccctaagactgaggaacagacaatgggggtcctcccaggaccatcctggacatccctgctgcaggcagtccagccactactccaccccgccacaagctcatggggtgggactgtttccttctgtgctttcaaggtggcctggggccatcctgccagtccagttctgctgatttccctaagaggccgactaaaagccagaaggaataccaactttgcaaccagacgaaactggttctaatccccactctgccatgcattcatcacatgacattgggcctcagtttgcccctctgtaaaacaggtttgttgtaagggttgaaacaagtgtctgccacactagctgctatgctcagcattttgggacatttccaaactcggtcccttcatggaagatggagagggaatgttctaacccctccttgccatgtacttgtctaaactcacttctcctcattcttttattatactctatccattgtttaaatttctcaaacgcaacaagtttgtttctgtgctacattgtgcccaggctgttccctctataagaaacggtgattctcaagtggagacaattttagctcccagaggtcacgagtcaatgtctggagacatctgtggttggcaaaagtgggcagggtgtgttcctggcatctagtgggtagaggccagagatgatgctacgcatcctgcaatgcacaggatggcacccacagtaaagaattatccatccccaaacatcagcagtgccactgctaggaatcccagtatagaaggatctctttcttatttccctcccaatggatcccttcttgtcttctaggtctcggttcaaagctgaatattcagaggcctttctgacctcctgcttatggccctcgagtttttctccacacccacatcttcctttttttttgttgttttttgtttgtttgtttgtttttttgagatagagtcttgctgtgtcgccaggctggagtacagtggcgcgatatcggctcactacaacctccacctcctgggttcaagcgattctcctgcctcagcctcccaagtaggggggattacaggcacgcaccaccatgcccggctcatttttgtatttttagtagagatggggtttcaccatcttggccaggctggtcttgaactcctgaccttgtgatccacctgccttggcctctcaaagtgctgggattacaggtgtgagccactgcacccggcccacatcttccttgctttatggcttgttcacaccttgcatgatgtatctttggcatgatcatctaactccatcttctcagctaggatacacattccatgagcagaggagaagtacaggaagctgcatcacttttgttcacaaaatgcactacttcgaatgtagcacggtagttgctcagtaaatgtttgttgaacaaatgaacaaaattgtggtaagtaaaattctaccagcaatgttctataaccattcccgtttatccctctgtcttatggacaaaagaaaacagttgtctttctagtgcctgtcatttttctcaggttcaaggatgtcaggtgtaccccattcaaactgaccagagattgtgcctccccagtaccttctgcagtctagggtctcccagcagatggtgggatgcccccaagcctaggaatgaagaagacccccagtgaccaagctgtgaagaagaaagcagccacttctagctttaaagagaggtaggtcttccttccatgcttgtaccttgtttgggttctgattcaaaactcaaactcttgggaatatgtgacctagatatttgatgccattaaaacatgcctgctaatattttaggtataagcatcattgtgatgctgtcttaaaaaagagatcttatcttttctagatatatactgaaatatttatagatacaattctgtgatatcttatatttctttcaaaataacccactgttgggggaagaggatgaaagtccagatacaagaacaatggccatgaattaacctgggtgacatccacgtgggagttcattacactattctcttggtactcttgtgcatgtttgaaagttgccttaataaaagttttatttttttaggaccccttcatctaggtctcctgggaatgctgaaccctatggcctcatgccatcagagggaggaagatccccctcttcacccccatccactttccttttcacccttgtcagcaaatccagatggaaaacacagtcaaaggaaaaagctgccctctcaagagaaaataacagcctggcacgatggctcacacctataatcccagcactttgggaggccaaggcaggcggatcacctggggccaggagtttgagaccaacatggtgaaacaccatctctatgctacttcagaggttgaggtaggagaatcacttgaacctggtgggtggaggctgcagcgagctaagatcacaccactgcactccagcctgggtgacagagcgagactctgtctccaaaatatatatatatatatagatatatataccgttcagaatatcattcaaagtatcatgccagtggcttccctcttgcttggactaacagccaaattctaggatcaccacgatctggcctcaaattactctctgactttatctctcttgttatgctacccctcacttactctgttacagctccactgaaccctgctgttcctcgcacaggccaggcatggacccacctctgggctcagcccctgcctttgcccctgcctggaccactttctctgtaggcgtgactctctttttcatcttcttctgttcttatccgtgaaaaccttccaggccaccgttggtaaaattacaactgtcccctacttttgccccttactttatttttctaagatatcatttaacttattttgttgtttgtctccctacttgaatggaagcttgtgatggttactattgagtgtcaacttgattggactgaaggatgcaaagtactgtttctggccatgtctgtgagggtgttgccaaaggagattaacatttgagtcagtggactgggaaaggcagacccactctcagtctgggtgggcataatctaatcagctgccagcgtggccagaataaaagcaggcagaacgtggaaggaataagctggctgagtctcccatgctggatgcttcctgcctttgaacatcagactccaagttcttcagctttgggatctttgggccttcgaccacagactgaagactgcactgtgggcttccctacttttgaggttttgagaatcagactggcttccttgctcctcagcttgcagacggcctatcgtgagacctcgccttgtgattgtgtgagtcaatactccttaataaactcctctttatatatacacctatcctgttagttctgtccctctagagaaccctaatataaagctccacgcgggttggagtttccgtctgtttagtgcactggcatatcagctaatagagctgggaaaaccacgtgctcagtctctatctgttgaatgcatgaatgaatgagtgaatgaatcaatgattctcaggtccaatcagaatcctatcctgagcgatcctgtggagactatgcatcagtctccttctgcctcgtgagttcccagccatgaccagccagagcaggacgtcagacaagactggcttggggcccttggctgccttacctgatggggtagtcggccgcactcaggttgatgaagaagtcccagggccagtcggtcatctccaggaggtcccgcatgctctgcaggtaggtggacaggaggctggctcctccccagatggtggccattctccagggggtgacgcggacattgctgtactgcctggagacctggagcacttgccgatgcaggtaattagagcgcttttcccaggagagaaagggtgatgacagtcagtggcctagaaaatacccaggcatgcccctcacccctgtcccctctctgtgtcttccctcctggttgggcacttctgagcacagtggcctttgccaagtaaatgatcctggactggagtgtctttctgtactgcaattcaaacttggattattttttacatttcaaattagctatttgaaatgcagattcactggccgcacttctgagctaatggttcactaggcttgggctggtggtgcctgggacttcacatttttaaaattttatcttattttattttattttgagatggagtcttgctttatttatttacttagacagagtctcgctccgtcacccgggctggaacaaagtggtgccatctcagctcactgcaacctccaccacccaagttcaagcaattctcctgcctcagcttcccaagtagctgggattacaagtatgcgccaccacgcccagctaagtcttgtattttagtagagatggggcttcaccatgttggacaggctggtctggaactcctgacctcaggtgatccgcccaccttggtctcccaaagtgctgggattacaggcatgagccactgcacctggccaactttgcattcatatacatgacagctgcatggggtctgaggaagacaagctgggaaatatggctccatctaaacccatgtatatttcggaggcagaatttttgttttctgtccccactcctactgattgctcctccattatcctctcacaggtctgctagaagccgaccttttggacaagacttccccctttgccttcttgactaaaggcataattgtttcaccaatagaaacctcagggacaaggtagctcgggagtcagcagggctgatgcaggtttttgttaataaagttttattggtacacagccatgctcatttgttgacatgttctccttggctgctttagcacaagggcagtgctgagtagctgtgacagagactatgtgccctgcaacacctaaaatatgtactatcttgccttccatagaaaaagtgtacgcactcctgggatagtgatatggtttggttgtgtccccacccaaatctaatcttgaattgtagctcccataattcccacgtgttatgggagggatccagtgggagataactgaatcacaggggtggtttctcccatactgttctcgtggtagtgaataagtctcatgagatctgatggttttacaccgggaaacttcttttgcttggctctcatttttctctcttgctgccgccatgtaagacttgctttttgccttccaccaggattgtgaggcttccccagctgcttagaactgtgagtccattaaacatctttctttataaattactcagtctcaggtatgtctttattagcagcatgaaaatggactaataaaggtaagctattcccacaaagtatgtgagaggcaggcagagggcattgggtagaggggagaggtaagaaacagcatttaggggccgggcacggtggctcacacctgtaatcccagcactttgggaggctgaggcgggcagatcacgaggtcaagagatcgagaccatcctggccaacatggtgaaaccttgtctctactaaaaatacaaaaattagccgggtgtggtggcatgcacctgtagtcccagctacttgggaggctgaggcaggaaaattgcttgaacccaggaggcagaggttgcagtgagcggagatcatgccacggcactccagcctggtgactgagcgacattccatcaaaaaaaaaagaaaaaaaaccccccaaaaacagcatttatcatttatggacaaaattgtaagtcgcagctggaaactttgaaaccaacacacacatagagacagcactctagggccacacgctctgtggagaggcagctggtcagcttccaagccttttctgaaagcaggcagtctggactagcaatgcagaaggagggtatcagggagggacggacagaccccgaagaaagcccagcaaggggtgatcacagaggcctctcaccttgtccacgtggatgtagtagaagtggtctttgtggtagatggccttgaacatgcgctgcaactgccgagaggcacggccgtggaccaccaggacaaaggcgattctgaccgggttggctggcatgtactccacggagtcctcgtcccactgcacgttcttgttggctttacctggggaaaatccaagagaacagagaggagaaagtgaggctctgccatcctttgcaggggtgggaagtttctctggtgcttcttttggggactattttaggggcacagtcatcaaattgggccttaaaacataattcaatgccacaaagcacatcttagattctcacactgtcaggcacaaaaggggttaggggaccctggggttgttacgacatagtttccattctgaggagcttaaaaatgctggaagagacacatggacacatattaagctactgaacaaggcaggaggaggtgagagctataagagatgtatctctgaatgacagaggaagaagcagttaatttcgagttagtgaacgtaagatacatgtgttgtttttgcctgtccagaattcattctcccttcttctaatagcatccaatatattgtttgttttaacggtggtaagaacagatagcatgaaatctcccctcttaataaatgtttaagtgtacactacagtactgctgcctattaatacaatgttgtacagcaggatctttaaatttacttgtcctgcatgactgaaacttcatcatccaataccttttgtggcatcatcctcctctcctctattcttagtccatatgggtggggaagacctaacttcatcatcaatttcaggggtggacctacagcttaggcctggccaatgggaatgctgattctccatagccacagtattgtttagagatgaacatatgactcaaccaagttaattaaccaataagacagaatgctagacttttgttagaactactacataagagaggttatctttttttttttttttttgagacggagtcttactctgttgcccaggctgcagtgcagtggtgcgatcttggctcattgcaacctccacctctcaggttcaagtgattttcctgcctgagcctcctgagtagctgagattacaggcacgcaacaccatgcctagctaatttttgtgtttttagtagagatggggtttcatcatgttggccaggctggtctcggaactcctgacctcaggtgatctgcctaccttggcctcccaaagtgctgggattacagacgtgagccactgtgcccggtgagaggttctttttctgttacacaggagactagaagattctatgagcctttctgttcccacacggagagaggttgcctgagaagaaaactaatgtggagtacattgccaaggggggatgagggtccaggtgcttgtggcctgccttgagctcctgcatcagtaaggctacagatcacccactgtcatctatcatgttcttttaaatccaaatcctataccacatccacttggataaatagtcccagacatattttattccgaaaatcagcctcaaagactcctctctttctttctcttgcttcagataaaaacacagcttcctagtttagtttattacaatcccaactagaaatctcctagctttcctcagcctgatttcacttgggtccaacccaatttcttaagagttctgggtttatgggacccaggacattgtcagggtagtagctgcaagtgtcccagcatctaaaccgggagaactgagatggagactgtggggctgggggattaggacatcgggagtctaagctgtcatcagaaggctgaatggttgctgaatgaacgaggctctttctacgtagttccaggagacaagacaagattgacgtagataatatccaaatcacactacacagcctctatggctggtgtgatctaactactcagatctctctgccctcgattggtgggtctcacattccatcttgtcctctggccttctttctcttcctcaaacaagctcatttctgccttaggaccttctccctggcttcttgtgatctggaacgccctctccccagatctctgcgtggctgcatcttcttgtcattagttcacagtccaaaaaggggactcaccaccacctcttttactctctttcacctcacccgcacctcttttactctctttcacctcaccggatttcaactttcttcatagcatgtaacactgtctgcaattgtttatctgtttacttgcttattatctgaacacaccactagaacattagctccaagagatgaggggctattttggccttgtttaccacagaatctgcaacacttgaacagtatctgacacacatctggttctcggtgaaacaaaagttacaggaaggcacatttgggatcagtaaaataacaataccttttattgagcattgaccagcccttgacgttcattagataatttaatcctcgtaatgatcctacaaagtaatgctattatccccgctttccaaatgaggaaaccacagcttagaagaggccaagggattggctcaaggtcacactgctttaattagttaagctgagattcaaacacaggtctgattccaaagatcatgccctgaaccactaatacacaccatatgatcatacctagagtttggaaggaaaagtttataacaattgcttttagttgcttgttgctaaccaaatactttgtaagttagttattgcaggcaggtaggcatgcatttaaggactaacataggtattccagtatttctgtattagatgagatgctgattctaggtgattaataaggctgtatcttttcatccatccatctattcctccacccatccacccattaatttattcatcgatcgaaatccaaccactcatccattcatccatccaccattccacccatttatccatttatttgtccatccaaatccaaccactaatctgtccatccatctacccacccattcatccatccctccacccatccacccattcatccatttattcatccatctaaatccaaccacttatctgtccatccatccacccactcatccatccctccacccatccacccattcgttcatgcatttattcatccatccaagtccaaccattcatccattgctccacccattcatccatacatccatttattcatccatccaaatctaactactcatctgtccactcatccatatctaaccattcatccatccaagcatacagcaaaccctccaactatgcatccagcaaagcctccaagagcttatcatcccaaacaccatccatccacttaaggtgtatggggcctttgagattaacccttgcttttccctgtagccatgaacatcttttgccatagtttttgaatgagcaaattaatgaatgtgttctgaagaagagtggctgctctgatccagaggagctggtgtttcttaagtgcctcctatgcatccattgttatttgaccctgggaagaatgcgttatcatcctctgaggctcagagaggtcagcacatttcccaggtcacacagtgagtgaggacagaggtgggaggggaagctgagtgttgccgagtccaaagccagccctgatatttccacttgctctctgcagaagtggagatttgcgatatagaggataggtgtaaggactctatgctggtctttaaaaagggcttggatgttgatgctgaggtcttttacaacttctctttagagttttaaaaggcagaacagatttacagacagacacagacatggatgcttttcttttggagaaagggcagagtcctgtgaaatcaaagacaaatcactccagcaagagagctcccttggcttaaatataaagtcatctttgggtcagacagttagtctggggagctgcaaagagaatggggaacaaaaaacccagagctcttctgagtacagctattctggggaaggggtgggtgggaaggaacaaaaatatctaaagaaaggagacatgcagagaaggagaaatagagatgcggatggggatggggggcagagggggaagacagcgagtcaggagaaagatcaaccatttactgagtgcctactatgtgttaagcaatttctgtgcatgattttattcatttctatcaaaactgctatgaaaacagagctattatctttctattgtaggcacaaggaagctgaggcttggagaggtcccagttataaagtagctgagctgagaatggagtgagtctgtgatcccagagccctgtcatggtcaccatgctcaatcaaactgtcctcatttcaaaaagaggaaaatccgtccctagaggaaatgtgtcagctttcagctgcaggacagatataacaatgacatgtggtcagagctatgtgggtctttatgaacacggaactctttgaaagaccaaaacccaaacagtgcccagctccaaaaaaaaaaaaaaaaaaaaaaaagaatttaacaatgtaatcagattcccatggcacaaaacagaaaataagtggaaaaatcagagtgattagaggcagcaggagaagctgacttcagatgaatgttaacaagccaggtttatcgagagagaatatcaagtatatttttgcagtgcaggtgtgaaggctgaggatgatggggggtcccggagagctcccccagtagatagctgtgctgtgttagttctgttactcaaattccctatttcttagcagcattgtgggtcaaacgaggactatgtaatccttgggctccaaagacatagcagagatgaaggtgctttgcaagggtcaacatgctgttccactgttgtggtgctggcaaagatcatgttagcagtgtcctgcaataatgatttgggaggagaaagcaaggtgcaggggtttagaacatgacctgtggtcaggcagatgtgaatgaccttggaccttttatgcaatctctccaagccttagtattctgatctgtaaaatgggtatgtataatcacagaatccaccccacatggacattcacatccagaagagagagcacagtgcctggcatctagcaaatcctcaataaattatactgtcatagccatcatttctatgtggctgctcatccacgatgatcaggatttaaccaacaggcccagctccagagttctacctcaaagctgcactgactcccagggctgtgtgtactctagagcctgctgcttgtaaataaacatctacaaccggaatttccctctgcagcgtatgcccagaccacaattaataacaaatgtgaaggagctgcttgactggaatagttactctaccaacaaagccctcgattctatttatactctgaaagggctgcttccggctgctgcaaggggcactttctgacttacttccaactaagagggttagttgggtcttgggaacacagagacatggaaacaaggttgtatgcaaatgaggcttgggttaggaagctcccagctggagcccagcttctatgctgcctgggaaggtgtgactgggattcagagctggggtgtagaatgcaaccttgcactgtgtggatttaggaaagacaccgcccctctctgattgtcagttcttcatttacaaagtgggaagagaggtccatctctgaccccgctgggttccagggtgattcatgatcacagatgaggaaaagtttcacagcggcagcaggcgcgttgcagaggagcgggattcgtcttactgggggagaaaacctgcacgctcaaggttctttgttagatctgggtgggagatgcctttatcctagtgggaaattttaaaagaggttttctggtgattaaacttgggagctgtctggtgcccagaaagaatcccctgctctcgatgggtttagaaaaggcggtgctgtgtggcgacaagcatactggataaagagcaacgaggtggattcaaattcctgcttctgctgtgaaccagccacgggggcctgggcaagtcaatttctttccttggtcctgtagaatctcaaagactagtaacgctatcagatgcatgtcaaatacttatcatgcttgcgtcaaatacttctcatggtggcttgcgtctgtaattccagctaccctggaggctgaggcagaaggactgcttgagtccaggagttcgaggctgcagtgagctacgatggtgtcactgcactctggcctgggtgacagagtgagaccctgtctctaaaaataaataaatcagaaataaacaaacactcattatggcctaagcaccagtcaaatgtgatctcattatttaattgtcccaaggtctcaggaggcaggtgccatgttagcagttggtgcgagaatggaaaccaccacttgggtgtgccagactccaaaacccctattttggaaaaacccaaatgagggagatgaaatttctggatatttctggaaatttctgaatcatctggaattctaacccgatccaggagttagcattgccacatagagaactgtactcccttgagagtcaggttggttttcttttctttcttttttttttttttttttttttgagacagagtttcactcttgtcacctaggctggagtgcaatggtgcaatcttggctcactgcaacatctgcctcccaggttcaagcaattcttctgcctcagcctcctgagtagctgggattataggcacctgccaccacgcctggctaaattttttgtatttttgatagagacagggtttcaccgtgttggctgggttggtctcgaactcctgaccttaggtgatctaactgtctcagcctcccatagtgctgggattacaggcgtgagccacagcgcctagcccaggttggttctcttgatacctgtcagttcgttccctatgagccaaggtcatgctcttatctcttgtaggatgccagccttgcccctggacctggtacagagctaagtttgggggagaggcctcaatgaatgatttctgactgacagatttagccagacagcttcatccacatacagggtcccggtggtggggatgagggggcaaagttgaagactcaggcctgagaggttgcccatggctgtctcctctcatccagcaaactggatggaggctaggcacccccacttttccttgaggcttttgggtggtctgtggacccttgctcagcagcaccaagccctgctgggaggaatcagtcaacggcccagactgctctgcaccgcagctgctgctcatgcggggccaccaggtcccctcccacccagcttaatgagaagagaggggtggaggggatgtgaactgggggtcatggggtccacagaggggagctgaaagaacataggtccaaggatgaaggtggccaagccagcacctgtcaggtctcaggagaaatgacccttccttgggaagccctccctgactctcttccccatcccttcatttaaaaaatatttttaatgacttttttttctttttctttttcagagattgagtcttgctttgtaacccaggctggagtgcagtggcatgatcataggtcactgccacctcaaatttctgggctcaagggatcctcacacctcagcctcccaagtagctgggactataggtgaccaccaccatgtgggctaattttgaaatgtttggtagagacagtgccttgctatgctgtccaggctggtctcaaactcctgggctcaagcaatcctcccttagcctcccaaagtgctggtgttataggtgtgagctactgtgcctggcccccatcccttctttgagttccctgtcacagcccctctgaacatcctgcacttctctttaaaaaaaaaaaaaagttgtagtccaagataatacatgctgagtatcccttatgtgaaatgcctggaaccagaagtgtttccaattttgaattttttcagattttgaagtatctgtgtatatgtaatgagatattttggggaagggacccaagcctaaacacaaaatccatttctgtttcatatacactttatacacatagcctgaaagtaattttatacaatattttaaataattgtgtgcattaatcaaagttgcattaagcatttatgtatagaattttccgcttgtagcattatgtgcccaaaatgttctggatttcggagtacttcagattttggatttttgaattaaggatgctctacatggataacatataatttactattttagccttttttggttcgagatggaatctcactgtcacccaggctggagtgctgtggcacaatctcggctcactgcaacctccacctcccgggttcaagcgattctcctgcctcagcctcctgaggagctgagactacaggtgcccaccaccacgcccggctaatttttttgtatttttagtagagatggggttttgccatgtcggccaggctggtctcaaactcttgactgcaggtgatcagcccaccttggcctcccaaagtgctgggattacaggcatgagacacatctggcctattttaagcatttttaagtttacagtttagtataataaatatacttacactgttgtgcaactattatcaccatccatctccagaactcttttcatcttgcaaaactgaaactttctatccattgaacaataacttcccactctcccctccttcagctcctggaaagcttcattctactttctgcctctatgaatttgataaggaacctcatgtaagtgacatcagacattattcttccttttgtgtctggatcctttcacttggcgcagtgccctcctggtttgtccacgtcgtagcctatgtcagaatttcattcctttttcagggcaagtaatactccactgtatgcatatagcacaattgatccactcatctgtcaatggacccttgaatggctttcaccttttggctgttatgaataatgttgctctgaacatgggtgtacaagtacctgtttgagtcactgtttcaattctttggagtatattcccagaaatggaattggtggatcataaagtcactatttgtaatgttttatttttaggagcccatcctgcacttcctaactcagctattccacagaaggggttagcctgggtctgcatcccagccctaccatttattaggaggtcactttgcctctcatgcctcagtttcctcatctgtcaaagagaactcacctctaagtgatgctgtaagcacagctataaatgaggcaaaataaagccatacagcctgattgtggaggagttcatgtggtgtgactccgcggacctcgcccatcacacttgaacttgtaactaatcacatggctggagagtgtttaacagggacctgatcctgaggactatagcgattgtggttttgtttttgtcttttttaaattcgtaagacgggatctcgctctgttgcccaggctggagtgcagtggtgtgatcatggctcactgcagtctcaaactccaggctcaagagatcctcctaccttagcctgctgagtagctgggactagaggcatgaacaccacacctggctaattaaatatatatttgtagagaccaggtctccctatgctgctcaggctggtctcaaactcatgagctcaaatgatcctccctcttcagcctccagagtagctgggaccagaggcatgcatcccatgtccatctaatttttttagaaaaattatctgtaggctggctgtggtggctcacgcctgtaatcccagcactttgggaggctgaggtgggtggatcacaaggtcaagagtttgagaccagcctgaccaacatggtgaaaccccgtttctactaaaaatgcaaaagcaggtggataacaaggtcaagagtttgagaccagcctgaccaatatggtgaaaccctgtctctactaaaaatgcaaaaatgagctgggcatggtggtgcacgcctataatcccagctactcaggaggctgaggcaggagaattgcttgaacccaggaggcggaggttgcagtgagccaagatcacaccattgcactccagcctgggtgacaaaatgagactccatcttaaaaaaaaaattatttgtagagataaggtctccctatgttgcccaggttggtcttgaactcctgggctcaagtgatcttcccccttcagcctcccagtgctgggattacaggtgtgagccaccttgcccagtgtgttcttaaatgcgatgtcagagttacccaagagaggattcacatgctgctcacatcgaatggcattgagtcaggggggactgtgaatcttttttcaattcttacccacctctcctgaataccctaccagcaaactctcaggtcaatgcaaacaaatcttcagcagcactcccctactgaacttccttttccaaaaagcagaatcctgcccccagaactggcatctccagcaggtaacaggagtgcccggctagcactgaatgccattgtttttgtttcactgatttcttcgcattgttgctgtctcctcatggcaagtgacagcaagatttccacttatggccatgatgcaaaattacttttaaaataaaatgtgcttacataaaaataaaggcgagtctattgcagtaaaaatactacaagaataatatggcaggtggaatgtggatatggcagaattgtgaaggctggagggatgcgaaggaagcttggggaatgttaattaggctccatgagctttgcttccaaactaggatgtgctgagtttgttaaacaaatgagaggaggtaaaggcaaagggcagggggatactcaagcagccccatccatcctgcaaggacccaaaggtccagacaatgttttgatctttctggatgagggctcccacttgctttaggggcccaggagggtttgtcaggagtctcctggggtgggcttttgggacagcacctccctgctagagagacagaagtctgtggagaaacactgtccttttgattcttactctaatttgttgagtacttaacattcatgtggttctttcactcatgaggcttttacctcttgtaacaatgctgcaaatgaaaattatccccatttatagataatcatcccaggctcagagagggtgaggaacttgcccaaggtcacagagccaagaggtggagaagaaattaggatacgcactgttctgacgtcaaataccatgctctatgaccaggctttggctagcaagaatctggcatcctcatcttcactcaggctcccatgctaagcttgatgggaaccaaagcctcatgttctcagaatggcttcaaaactatcgtctcccctagagcaagatttctcaaccttggcactattgatatttgaggccagataattccttgttgtggaggggactgtcctgcgcactgtaggatgtttagcagcatcgctggatctacccactaggtgccagtagcactcacctagttgtgacaaaacctaaaatgtctccattcattgatgtgtgtccccctggtgggggatagggcgtggagaggcaaaatttgctcccagttgagaaccactgttctaggacaagctctctagatgtggtctctgatgagcagcatcagcaacacctgggaatttgttagcaatgtaagtttcagccccaaccccaaaccttctgaatcagaaactctgggtgtgggagacaaggactctgtgttgtaagaagctctccaggtgattgtgatacaggctcatgtttgcctaggccagtggttcttaaccctggctgcacatttaaaatcatctgaacatcttttttttagaaaaacatcttcatgcctcggccccaccccaataaattctaacttaattagtttggtgggcgcaagtattgggactcttttgaaactccccctgtgattctgacatgcagtcagggttgagaaccacattttggacaccttttcttttcttttcaaccatcttttaaaaaacgcatctctcgaggtggaaagaattttacccaaacatatctttggctgttgcctcaaatgctcatggccactcactccaccagagactgaaggctacctcattcattatttttctcccactctgagaaaatgtctccctccacccccgaccaagcactcaggacattttcctgctcactgacttcccccgaccccattcaagtctggagttattaaagaacagcccatgactgaaccgtcttattgattttattgttcagagccctgggatattctaatgatatactgctcaataaatggaaactggtgggatagatattgacggtgtatggtacatttcactgcaattcactgggtcccagtcacttggcctgtaacatatcatctgtgaaaacgctgcgctgtggcctgcaagctcttatccatcctgctgatgttaccttttctgtgcatcaaggatgaaagagctattatgataatagcaatgtggccactgtgtgccaggtcctgggctgagcattttctaacagacttgatatggtttggatctgtgtccccaaccaaatctcatgttgaatggtaacccacagtgttggaggtgggacctggtgggaggtgactggatcatgggggtggatccttcatgaatggtttagcaccattcctttgatgctgttctctagagatctgcgtgtttaaaagtgtgtggcacctcccctgtcttgctcttgttccggccctgtaagacatacctacatccccctttaccttccaccacaattgtaagtttcctggggcctcctcagaagcagaagccttgatgtttcctgtacagctcacagaactgagagccaattaaaactcctttctttataaattatccactcaggtatttctttatagcaatgggagaatgaaccaatacaagaccttacctcatttactcctcacagcagacctttgagggaggcattctgactattcccattttacagataaggaaataaagactctgagtagttacctgacctggtcagctaatatgctgcagaactgggattcaaccctccatctgtcagacactaaaatggggacttttaacccctgagcttctattgtattggaacaacctttcttttcttttcttttttttttgagactgagtctcgcactgtcgcccaggctggagtgcagtagtgaggtctctgctcactgcaacctccgcctcctgggttcaagcgattctcctgtctcagcctcccgagtacctgggattacaggtgcccacccccatgcccggctaattttttgtatttttagtagagacagttttcactatgttggccaggctggtcttgaacccctgaccttgtgattcgcccgcctcagcctcccaaagtgctgggattacaggcatgatctgccgcacctagccatttgagcaacctttcagagggtttcagcacagatcaatatttcacagatcctcctcccttctcaagcagtatttctcaacagggactactgtcacttgggaagagacaattctttgagtggtattatcccatgattacagggcatttgaaatccctagtccccataacagcctctcctcacttgcatttcccagtgccccctaggggaccagcatggtttgagaaccactcatctccctgggaggcagaaggcttcctgccaagatggcctcccactttttggcaaacacaggtagccactctggaaaggctacatagcagagtggaaagaagtttcgttttgaaatcggacagatctgcattcaaaccatggctcttcccccattaactctgggaggtcgggcaagctatataacctctcaaagattctagctcatcatcagtaaaatagggatacatattgaccctccttcatagggaggaactgatggatggaattatgctcagagaagtgcctagtacagagcagtagctctgaacctggggcattatgtctttcccctgtctcctatgtgctctttccaaactcctgatccatagaatccaagagcataacaagtgatggtgttttacgccactaagtttgggggggtttgctacccagcagaagtaactggaacgaatgtctatgatatgccaggcaggcaccattctgggagtgaaaaatagactcatgcacacgccacaagagcttttgcttatgagaagcagcctctcctgagaaagaagacagataataaacacataaatatctccaggaccagtatgtggtatgcagaaaatgaaatggtggccatcattattgttgccttaaataatgatttgcaaatgactacattttctcttctcctctttccaacctcatttccctctatgctcctccaatcaccctttctgtgaagccaaaatgttgtttaatctcacgaaacctctgcttctgtttctcgatgctgaggtatcctttccttttccaaagacaggatttgctaggactgaatcgtgtcccccgaaaattaatatgttgaaggcctagcctctcctgtgaccgtattggagatgtggcctttaaggaggtgattaaagttaaatgaagttgggccgagtgtggcggctcatgcctgtaatcccagcactttgggaggccgaagtgggtgggtcacttgaagtcaggagttgaagaccagcctggccaatatggtaaaaacttgtctctattaaaaatacaaaaattagccaggcatggtggtaggcacctgtaatcccagctactcaggaggctgaggcaggagaatcacttgaacccaggaggcagacgttgcaccactgcactccagcacgggtggcaaaacaagactgcctctgaaataaacaaacaaacaaaaaggttaaatgaagtcctaagggtggagccttgaatttaggggatttttgctcttagaagagacactggagagcttgctatttctctgccacatgaggtcacagtgagaagtcggccatctgcaagccaggaagagggccctcactagaacccaaccatgctggcaccctgatctcagattcatagcttccaaaatggagacaaatatttgttttttaagccacctggtctatggtaattttttttaaatgatagcccaggcagactaatatacaactcaaggaggccagggatgtgccccttagactacaattgacaggttgagtgaggagttaactaggtaagagaagagggaaaagtgtccctaagtggagggaacagcatatgcaaagggcctgtcacgaatgatagtatggtaaggagaagacatacaggaaggccagtgtggctggaactgaggccaagaggaagtgcagaagatgaggatgggccgacagcagaggcatcacacagggtcttgggtaccaccttaaggactgcaattgaagagagtaacaagccctttcatcaggcttgttatccatggttgaggagtgggtggcaggcaggacacattttgaaattcccagatggggtggtgtgggatgccttgcttcatggggtggaaagacaggcaggggcccccatatcctgcactctgtgcttcgtgtgtccagaaagcctgctctatctgtactccctgccctcttgacccagaggctgctgtgtgcaagttctcctacgagccttcctgtcgcttgacattttcatctctgccctcgtttctcctctcttgaagggactcgcaggctcaataaatactgccatggaaaaacgcagcgactcatctatttttattacaaatggagcctctcgaggagggaacaactcttatttacttctcagagggagggttttgacaacaggtttattttctccaactctccaaggattaagtgagtaacactctaaagttaacagtacattaattaatgccaaattggttggaattttcctaataaaaatcctcatagtaatcacattatgggccattaacgctgcctcctgatcataaaccataaatatgttctgcaggtgccttcttttaaaaaagggacatttctccaaatcgtttcccatttgtcacattaatgctgtcacgtcacataatgcagacaggaataattataaaagctcatgtgggtaggatttactttgcgctggtcactcggccaagccctgtacacatatcatctcattgagttcttgcagcaaacctatgaggtcctgctatcattctcattttacacatggggaaactgaggcagacagaaagagtgtaatctgcccatgatcaaatgctagcaagtaatggagctaggatgtgagtccaagcaaactgattccaggatactctgtcatcctgcctcttgaaatataaggactacatctctaagcacagtggtcctcttcgtcaagcctactgctaatgaaatctccggttgatcacaacagcaacgagcagcaatagtcaacacaacatttggttttgctcctagagggcagggatggtgtttcatttacttggcctaggagagtgtctggtgacaatgccaggagcacttggaacatacagtaaattcctgttgaataaatggacatagaaacacacatgcaacagggttcacaacagtgggtaacaacgagcacctcaaatgcactgggatctcaatagatccctctccctgcaatgatgtgagctgggctcagcctcaggccggggctctgatacacagacaaggagaccacaccacttggggagctgcagttcctgggagaaaaccaaggaggacctcgtttcgaactctgttctagcttcacttcttaggtgcttctgattgtttcttggatttctctgtctacaaagataatacttactgtagaaaattcaagcatacagaacaatatgaagtaaaaaaaaacccagatattagtgccaaaatatcaccattgttaacaaacgttcagtgaacattttgcaaatagttttatgcactcacgttatatataatcatgtatgttctgctttgtcatatgcattctgttttcagtaatgtactcctgacatcttttcactgtcagtgaatacaggcattctctctttccttcctcccaccctcctccttcccttctcaaatgttcacagagcagctacgctgccaggcactgagaatgcccaaatgaacaaaaccagtgttgaatctgtattcaaggagctgacagtccagtggatgttggatggagaaaacagatcaacgtattttacaaaaggtgttggatgcaatgaatgaaaagtacgggcggccaggggaggagagagatggggccaggtgatctgatgcaaaccaggtctatagacctttccaaagaagccacggtgaagctgagctgtgaaacataaagagtgagccaggtgaaaggatgtcactttggaaggaaggaagaccatgtgtcaaggtctcaaggcagggagggtcttattttgaataataataataataaaaaaaaaaaaagacaaaaaacgttgggggtccaggcgcagcggttcacgcctgtaatcccagcactttgagaggtggatcacaaggtcaggtgttcgagaccagcctggccaacatggtgaaacctcatctctactaaaaatacaaaaattagccaggcatggtggtgcgcgcctgtagtttcagctactcgggaggctgaggcaggagaactgcttgaacccagggggtggaggttgcagtgagccaaaatcacaccactgcgctccagcctagtgacagagtgaggcttcctctcaagaaaaggcaaaacaccaaaaaaacaaacaacaacaacaagaacaacaaaacaaagcgaaaaagcaaactcaggggtggggagaggggagtagtgcggacttttgtttttttttttactttcctttggtgcttttctgtatttttaagacttctgtagggtaatgacaagaacttactgagtaagtaattcagggccactgggtattttttcttagatgcctccaaagatggaaggctcagtgccttacatagcagggcttgtgctcagcagtgattgtgagctatcgcttccaaaatgtgcctgctcgaagctttcatccataggtcctaatttggtcttcaaagatagtgctgctgcttctctggcaaaccaacctctcaaatatgtggaaattgttattttgctattactccggcccccatctccctccaaatctaagccacctgcatattccaagctcattcaatttctctcctacaacatgtaaggtctctttgtcatgtttcttcctgggagtgactagaagatcctccacgggcacagcctgagatcactgtaaaaactttgaaatacctcccaagcatgtgccagcacaaagtcatttgttcatttgatgaataattataaatgcctgtgagtgtgctataccctggggcagtggcagggggcagggtgtgaggtggagggggaagacagcagtggacaggatggacttatcacttatttgagaaataattatcggcagggcatggtggctcatgcctgtaatcccagcacttttggaggccaaggtgggtggatcacctgaggtcaagagttcaagaccatcctggccaacatggtaaaaccctgtatctactaaaaatacaaaaattagctgggcgtggtggcacatgcctataatcccagctactgaggaggctgaggcacaagaattgcttgaaccaggaggtggaggctgcagtgtgctgaggtcgtgccactgtgctccagcctgggcgactaagcaagactttgtctcaaaaaaaaaaaaaaaaaaaaagaaaaagaaaaaaaaagagaaataattatcaaatgcctgctactgggtgacacactgcagggctgcacactggaccagatggacatgataggcgaatctctaaataaatgtgaaatgaatgaacgctacatcttgtcttttaccattacagcatcattgaggggataaccattatgctgtcttggtgcttgtattaatcgagtcaagttccctaacattggtttgagagctccaggcaggtcactcttcgacctacctggaagaccagagagaccctgatttctcaacgatggcttggaaacttcatttaagccagggggctcctgagaatacttttcttttctttctttctctttttgagatggagtctcactctgtcacccaggctggagtgcagtggtgcgatcttggctcactgcaacctctgcctctgggttcaagtgattctcctgtgcagtggctcacgcctgtaattccagcattttgggaggccgaggcgggtggatcatttgaggtcaggagttcgagaccagcctgatcaacatggtgaaactccgtctctactagaaatacaaaaaaattagcagggcgtggtggtgcatgcctgtagtcccagctacttgggaggctgaggcaggagaataaacttttctaaataagaacctctctgaatgaactgacagaggaagctcattttaaacatgagctggcccctagaccagagaactgcaggggaaagtgggtgggtcctaggattttttgacaggatgcagttaagataagcctttaaggagacagaacgtgtgctaccacagcttgggaaggccactgacagtgaaaacaatttaaattaaattaaatttagtcagctccaaaaggaaacacatgtaatgttaatttcatgggtgtaccaatgtgtaaacctaacagatgatacttaaatgagaaaggcagagaaatgacatttggttaaacaatgcatcagtgggtaggatttgttgaaactgccatttaaaaaaaaaatatgagcacaattgaaatctgagcaagctgtcacccaggccaggccacctaggcgttctcatataacacacttgagagaagcagtgggtagccgggattggaggcagtctggataaatttggggaactcaggtcaatgtctgtgttaactttttgtttttgtttttgagacgtagtcccactctgtcccccaggctggagtgcaatgccgcaatctcggctcactgcaacccctgcctcctgggttcaagcgattctcctgcctcagcctcccgagtagctgggattacaggtgtgtgccaccacactcggctactttttatatctttagtagagatgggatttcaccatgttggccaggctggtctcaaactcctgatctcaggtgagtcacccgcctcggcctctcaaagtgttgggataacaggtgtgagccaccacgttcggcctgtgttaacttctgatgctcttcctgggcttgtttgcctgggcagataaaatcatttgcttgtctctccaactatgactgagatctcaccctgggcagaaagtgcgcctttgcttgtttatgtccttttcttaaaagcaacagattgtgtagtattggaggtacatgaaaatgtggaaagattggctttctgttttatctctgtcccttggcacaaaataggcactagggcaataaatgcagaatgagtgagtgatccagacactccttggccatgttttccacccttacggcttcatggtggcaacaacatttccttgcctcttgttaataatcatcacctcctaacatattgtttggggtcctcgtccctctccggcagccatcactccttttcaatattcacagaaccatgtcctatagtcaataaagctacgggaagctgactgattggcaaaaaacaggtctctactaaaaatgctaaccccagaaacaatgcatacacactgaccctgccagaaatatattgacaaaagccagcatttttttaagcacttactatatgccgggcatggtatcaagagtgttttcggttggttggttggttggtggcaatttttccagttcatcgtctcaaaacactgagacagatgccatcattatcccacttttgccaaggaagaacaggttgagactcaagaggttatatagcataaccaagatcacacagctagtggccaagctgggatctgaacccagactaacctgcttccaaagccattactccaacctgccttaaatgtattaagaatatgttttaagcagagtgtggtggggtgcacctgtagtcccagctcttcgggaggctgaggcaggaggatcgcttgagcctgggaggttaaggctgcagtgagctatgatcacgccactgtactctaacctgggcaacagagtgagaccttgtctccaagaaaaaataaaaagaacaggtttcagatgacttataagagaggaagttgacagttcctttgtgctttacatagagcactaaaatccagtatgagccagggcaatgctgggctcaacacatggatcccaaaatcgcagtggcttgaacccaacaaaggcttatttcctgctcctatgcagcttgagcagctctcctacagggccgtcctccaagaggtgacttgaggatccaaattgcttcaactacacaatcccactccttagcacccttctcttgcagtgcacagagaggacagcgattggcatgacaaattcacagcccgtcaactggcttggccaagaagtaaccatcatttccactcacgttcctctgagggagactgaatcctaggacccgacccagatacctgggagttagtaatggagagaagaacatgggtcctagaggaacatttatattttatgtcacagaaacatactaagttatgccctaagccagcacttcttgaccagggacaattttgtctccctgaggacatctagcaatgtctggagacatttttatttgtcacaactggaagaaagaatgctactggcacctaggaggtagaagccagggataccgctaaacgtcccaccatgtacgggacggcccccacagaagggattatctggttcaaaatgtcaaatgccaaggttgagaaactgcttgaaacccgtgatcctgaaaaagattgtctgaggagcttattaaaatgcagaatctagaccgggcgcagtggcttacgcctgtaatcccagcactttgggaggtggaggcgggtggatcacttgacgtcacgagttcaagatcagcctggccaaaatgacgaaaccccatctctactaaaaatataaaaattagatgggcacagtggtgtacacccataatcccagctacttgggaggctgaggcatgagaatcaattgaacccgggaggcagagattgcagcgagccgggatcgtgccacagcactccagcctgggtgacagagcaaaactctgtctcaaaaaaaaaaaaaaaaaaaaaagaatcctgcattcctccctccagatcaccaccctggcagtatttcagtattttcaggggccctctggcaactgtgacggccgctcttcgtgaaccacactcagggaaacctcacaggaaagaggaatcaagaacaccaagcgggggctgggactaggcgctgatgaactcacacagagacacccctcaaatgcttcagggtcagtgtgaggcaactgcgccaggaaaaaaaaaaaaaaaagaaaggctgacatttgttaagtgcctctctctgtctctttcgtgcaagccttgaattgcagggaacatattctaagactaacctgtcagccagtaacaactaaattactaaccttgcctcccgctgtgccccgtatccctgtcagatgcacagtcgcactcacagaggaatgcttcctggagatgtgttcccagcattggggaagctgacccttttgcaggaacagagccacgtggtcacatgtatttcacaggggccagggggctggaaataacccaaaggaaagggaagcaactctgggcagagcagtagggcaatcagagtggttgaggctcttggtcaaaaccacgtctgctttattcatggcactcactacaacctacttcacatcgtttgcagtcaggtcttgccaagaggctgtgctttagccaataaaatagaaatgtgatgcacacaacttctaggcttacccatggacacctgtgcatgcttctctgtgctatttccctcttcactgtctgggtgcagaagagcacggtgaccttggatgctgtgtgttgaagatagtggagatagtggagtcagatggaaagggcctggatccctgaattacaacatggaggggagtcaatcaggaacatctattttggatggcagaggatgaagacatcaaccatcttcatgttagagacattatacactggtggctgtgttccaataaaatttgacttacaaaacaggtggtgggctggattcagcccactggctacagtttacccatctctggttgaagagaagctctatctaccaaataaagtactagtcttccagaaagagttatctgattagacagtttgccctgtgtgacctcaacgcaaacaaacattgctacgtttgattgttatagcagctgatgttccctaactaatatagtgattctatacctggttactgaaggcagaaaggcttgggttcaaattctaggaccagacctcgctagctctgttatctagagaagctaccagaacctttgagcttcaatttcccaaagtggaaaatggaaaggaaatactgaagaaggtaacctgacatattttaattgaaggctgtggtatattggtcatctaggagctgttgtacagatgttctgattgttgaccacattctatcagcgacaagacggacaggaggaaaagcaaggcattgagatgggtgaaggtgaaccatttacaaagcctaaactttccatacatttcttacatgaacaaatgaatgacccaacgaacacttttagcagcatctgccttctatgaagaccaggcacgtgcatgcctaatcaccctttgggggcaagagccatctgtgatttggcttgttttctttcacagtcttatttcgcagtcttatcagtgtatctgtgcaaaagattactcagtgtacgtgcacttgttagcagatgcagggaagctatcacaatttagaaagcacgtgctttatactttcaagtcaggcttccctctgcgtcctggctctgtcacttatttgatctgtggtcttgggcaaatggcttcatgaactcttgaagcctcctcagcttccaaatctgcaaaaggggtatgccagagacagctaaccatccatcaacatccattttcccctctgttatacacaattacaaatgagaatgtgacacttatcaacatttcttcaacacttctcagcctctcttgtagcgaggtgcatgaggctctccctagattttaagacaggaatcttaaatattttattttctataagaggacagacagtaaacactttgggctttgtgggccatatggttctctgttgcaacttctcaactctgccactgtagagagaaggcagccacagacaagaccaaaacaaatgagtgtggctgtgttccaataaaacttaacttacgcaacaggtggtgggccggatttggcttgtgggctatcatttgccagtccctggtttaacagatgctcagcctaccaaatatagtattagtcttccaggaagagtcatctgattagacattttgtcctgtgtgacctcgtaagccaccaattcttattttacacacacacacacacacacacacactctctctctctctatttataattggtctgtgtctctgaaattctcatcatgttctgaaacgtcaactgtttcctgatctttaatcccagtctccatgggccatgtccctctccctttcctcctcctttttaggaccaactccataatttgcagggctcactacagatgaaaatgcaaggccccttgttcaaaaaatattaagagtgtcaagacggtgaaagcaaagcataaaatctaacatggggctttctgagcatgagctcaggttacaaagtccaccaagcagaccctgctggtctggcttgtattaccatcagcaaacccagaaagttttctgcctaatttcttgacaagtccagaaacttgccacctgcgagctgcttgaagcgtttcaggaatggttttgcacatcacaagaagaaggaggaaaaaaaaaaaacccaattttcttttagtatattacttgttagacagcgaaatggaatataattatggtgtgacatttccaacagcaaatatgttccagtgtaagcaattaacaccggttcttttggcaggcttaaaaagattactcagagactgtggtaagttacaatgccccatgaatcataaataatgtagaatcgcagctaagttgcattctacgaccaaagttcaaatttcttgatgaaaataaattgggtgcttttaaccctctgttgacttcatgtggcttaagcagattcggatcataagttctttggatttttgtaaattacatatttaccttacccctaagaacatctgcaaaaaattataaaaaaaaatctgcatgtattcatttcagctgctggaaatttgcatgaggtagtgggtttgaaggggacccctccaggatggacagaatgggggagacggcttacactgagaactattatccttggaggctgttatggttaaatgatgaagtcccaagatttagtagaaggcatatctggacctatgtccctattctctctgccattcttgacacaaccaaagggaaggcagcaccttctgaatgtatttgtgcagcttgtgactctgagcaactgaaaccaatgaaacaccagcagcagttacagagccacataccgtagggacattcaaggccaccgttacattcaaagcctcagggccgtagtacccttgtactatagcactactagcactatgggctggataactctctattggaggtgacagcaagctgtcctgtgcattgtgcagtgcccaggagcatctctggactcgatccactaaatgccaggagcatcctttctttagttgtgaccattaaaaatgtttccagcaggcacagtggctcacacctgtaatcccagcactttgggaggctgaggcgggcagatcacctgaggtcaggtgtttgagacaagcctggccaacgtggcgaaaccctgtctctactaaaatacaaaaattagccaggtgtggtggtggtggtagtgccagctactcaggaggctgaggtgggaggatggcttgagcccaggaggcagagattgcagtgagccgagatcacaccactgtactccagcctggatgacagagtgaaaccctgtctcaaaaaataaaaacgaagtttccagatattgccaaatgtccctggaaaaaaaaatactactttagatagacctgggtccatcactgtgtggccttgagcaaatgacttcattgctttgagcctcagtttccacatgtgcaaaaaaactcccatgcctaccttacagagagattgtgaggctgggatacaatgatgcagatagagcgcttagcctggtgtctggcataaagcaagcattcagtaagacagatgctatttattccatcacccatttgattgtttacaaacagctcctgagcacagtggagccatggcaggtaccaggggtgtgaagacgcataagccttatctctgtctcagacatgctaaccaacaacgtcagtgcaagggggtgctccctaaaatgaacacctggtcatggggcaatgggggcttggagaaaaatacctaaatctcgagacttcatggacaggatggcacctgagtaaagtaaaagttttccaggcagacacacttggggaagggcattccacacagaggcaactgcatgtgcaaaggtatggtggtatgagtcactcagaactcccctgagctcaggacggctgggaggtgaattctacaatgcaggtaagggaggaggagcagcaggaacaaggctggcaggcagagggcagatgaggaaggatcctgagatgtcaaatagttctcatctctcttgtcaacccaatgaactcatagcaaagctgagtccaaatcctgccttgcaggacgcaatgcagtgattgattagcaatgtctgctttggcccaggaaggtagaagaggctcaagctgcaatgtatttccttgtttgatgagggttttcatcaggggagtgatgtgaggagaagcacattttttaaagctcactctggaagccatgtttttttgtttttgtttttgaagagaagacagaggcagaaatggagcaggagaaagagttgggaagtgactgtaatactaccagacagagacaatacatgcctaaagggcagagcaggaggctggggaggaggagacagatacaaggtatttaggacctagaaatgatagcgactttgtggatttaagggagtagaaataacagagactcttggatttttggtttgggcaacttggggaataacagggttattcacctaggaaaaaagttcaggagattttggaggcagaaggatggtaggttatttttcagacccttagctcgtggaaccccaaggtagaaatgtccattgactgttgtaggtttggatcaggaacccagaccagtgatgaggaatagagtcattgcttagatatggcggctgtcttcactggccaataagtgagctacagtgaccctgcttctccagcccctggggaagcccaactgtaaatgagaaagacagctccttccagtgggattctttcctaatctaaaggcattcccgattgacaggattagtgaaggacgacagaagaaagtcattactgaataatcccctgcacatttcatagtcaacacagcattcatatgatccttgtaatccaattaggtgatgcaggaagctatatcttaattcctgacttcattgtgacttgcctggtcacaggcaaaccttgtttaataaggtgtcacctaaacactgagtggtgcatacaaaatgggcacagaacggtgatggggttgggggctgaggggaggaggtgactgctgttgagaatatgtcctgtctcaagcagccaataggggacttagaagctccatgtcctcatcagcgaggcttgtgattggaggaggcttgtgattggaggaggcttctgatcggtggaggcttgtgattggagaaggcttctgattggaggcagcttcatctccccttctctccatccattttgctcctccggacctgtgtgtgacaactgtctgtctggtggctggaactcatctgacaataggaacaacaatcatttttacatgattgctacttactgagggcccacttcatacctggcattttacacacctggcccaaaacacccttgggcagagtagattgtatcctcattctaaggatgagaaaactgtgactcagagagattaaggcatttgtctcaggccacacagctagagttacagctgggattcaaatccagatctgtttgatttccttttatttttattttttgagacacagtctcactcttttgcccaggctggagtgcagtggcacaatctcggctcactgcagcctccacctcccaggctcaagcaattctcctgcctcagcctcccaagtagctgggattaccaatgagtgccaccaagcccggctaatttttgtattttttgtacagatctgtttggtttctcaagttagtgtcattcgcctctggcaccatgcccttctgaggtgagattccagaactgacgtgcaaaaaatgtgcaaaaggcctcctgaactgtagcccgggccagtcctggcccgcatgtccatgtgagggctggtttgcctccatcctccttgtgcatgtgaccccagctgtgggcttatgtggaccggatgaatgtgactgtagttacacctagatcacaaacaacatctgagaggaggtgatgcctctgatctctatcagaccacgaggaaactagagagtatggagtctactccaagtgctgggctaggccccagccttatggcttatgctgggatctcaaattccaggccacactgggctacccatgtaaggtcaatgagagaagtaggccaggtgggggcagaggcaaattagaacaagcccattcaccctaacagaggtgatccattctcagcgccaatcattttaccatggggaatgcattccaagttgctcagtcttctggttttccagaagactccagaaatacttattcttatgggcattatcccaattttaaaatggttacaaattcacatttgtaaaaaaataagctgtatgtgagtgtactgggttaaacggcatccctccaaaatcatgtccactcagaatctcagaatgtgatcttatttagaaatacagtctctgcagatataattagttaaattaagatgagttcatactgggttagaatgggctagaaatccaatgactcatcttctcctaaggccatgtgaagacatgcaggaaggtcacgtgctgatagaggcagggactgcactggtgcatctacaagccaagaaacaccaaggaacgccagcagcaactggaacctaggagagagccatggatgcttctccagatcctctagaaccaaccaaccctgctcatgccttgagtgtggacttctgacctccagaactctcattctccaggacgagagaataaattcatgttgttttaagccacgctggttgaagcgatttgttatggtggccgtagggaactaaaacaaagagccaaacccaccagggctgcgagaggaatgtgcccaactgtccttcccatgatcacaggatcatgctcttgatcctgtccctgtccacctcctcgtctgaagcttgactgattcactttctcccttgcattgctgcctgtccactatgctggcctccatccttcctgggctagttccgatgtccccattttaacagcatttcctgatattggccactctaagccttccgtgagcagtagatggtcctgctctgcaccctgaaatctgcctgctgtctgtcagtcaactggagttgttttccaaaggaagctgatgagaaaatccaaaggcttgtcttcatccattctccgtttttcttccagagcttccaacagctggaggccgcctcctctttttggaataccctgctcttttggcagccctggtcctgcccttccaaggtcatctgagcacctttcatcacttcccttggctccgtgatagccttttctttcatcctccggtcccttcaatgtaggcatttcaggcctattctcttctctatgctttaaataagctaactcagtggccctcaactggaagtgatatagccccctagatacatctatcaatatctggagacatttttcattgccacaactgggtgaccctgtactaccggcacctagtaagtcgaggccaaaggcatccaaggggcacaggatagcacctgacaataaagaatgatccagcccaaagtgtcaacaggaccacagttgaaaaaccctgagctaacagaatcccactttgatgctcttgatcatttatctcatgacttgtgcctctcaaggaactctagtcttgaatgtgttcagaaggaaacagttcacgcattgcttcttggagatttccaatgtgcatttgcccttgaaaggctctgacaaggtctgcagccaaataaaaacttgctttgcatttgtttaatccaccatttcctaatgtatttgaatacagaaatcctttgtttaggcaataatcactatcattcttctgaagtaagctgcagtatctaacaatttattgagcatttaccatgttctagagtgtcctaagcacttcacacatcctacagggcctttctccccacaggcagtggggggcagtggggtgcagtggataacagtgttggctctggagtcaggtagctggcttggaatttgcagccacatcagttgagctgtgtgaccttcataaatgccttcatttctctaagcctcaatttccttacctttaagtgagggtacagccatgcatcacaacgatgggatacattccgaggagtggattgttatgagattttgttgctgtgagactatcacagagcgcagttacacaaacctacatggggtggcttagcacatacctaggttatatgctcctaggctacaaacctggacagcatcatactgtactcaatactgtaggcaactttaacacaattttaagtatttgtgcatctaagcatatctaaacatagaaaaggtacagtaacaatatggtataaaagataaaaatggtacacctatataagatacttatcatgaatggagcttgcagaactggtagttgctctgggtgagtcagtaagtcgtgggtgaatatgaaggtgtaggacattactgtacattactgtagactttataaacactgtacacttaggccacactcaatttataaaaaaataaactatgatgttatgactacaatgtaactagtccataggaatttttcagcccctataatagggctgaatagtcaacgatggactgcacatacaatggtggtcccgtaagatattataatcttattataataatctattattatatataatcgataattatatatattataatatataatagataatagattataatcgattatatataatatattatacaatatatactatatataaaatatataatatatattatatatacaccttcatatttgattatatgtaatatattatatataattattattataatctattataataagattataatatctatatctataatagatattatactcttatgggaccaccattgtatatgcagtccaccgttgactgaaacactgaaacatacagtgcatgactgtgtctgtgtgtctgtgtctgtgtgtgtgtgtgtgtgtgtgtgtatatatatatatatatatacatatatatatatatattgcccatgtcaaaaagttctgaatctcaaattagataaaacttgcaaagggctttatggtatgttctcagtaatgttgattattgattgattgatgatgatgaagatggcggtggtgttggcagtgatggtggtggaggtgatggtgatagctgtgatgactgtgaaggcgatgacagtggtggtgatggggataacaggatggtggtgaaagagataataaggtggtggtgatggtgattctgatgggggcggcagtggtagaggtgatagtggtgttggcaatggtggtagtgatgaagatggtgatgatatgaggtggcggccttcgtcatggtgttggtgataatgttggcagcggtggtgatggtggtattgtactctctatttggactgtccttcttgacctggtgaaattatatactcgcctacttatttatctcaaagactacgacgttttcactgattgccccctttgggcataattcttcctcttttgtgtcatatttttttaatgcctccaccatatcactctctgacatacactatcaggacttgtctcctctgctcttcagggggcaccttcccttcacctgccacatacaaagaggggccgtttaataaatgcatgttgacatcaaatagggtggattatggggcaccagaaccttccaacaagcctctccccaactccacaggaaaaatgacaacagaaagcaactcgatgagaattttgcatcccctgccggcttcaaggagacctcaaggcaaactcatgcccagcctcaaaacactcagaaaatgggaggtggcaccagaagacaagtttcattgcaggccaggcactgcccatcctgcttgaaaacagtgagtgatggatgccagtgctgagcaaagcaaaaggagggcctggaaaggaagcagcctggtttcccgctgcaagctagtgatggagacttctgactgcggaagcgagcaagagtcctcagagcagaaatttaagtaggaaggtgtggtgcagggctctgcgcatactaagcggcctgcagacgcgccctgcttcaaagcagagattgcaggctgccagctcctgggcctgcccagcctgcagacagcttttcttgggctcacactctgttgtgctgctttgttttaaattaaaatagttgtcagttaaatcaagagatttcagattaaaactcagatttcttacaaaaagaataataattggaagagtgagcaagcaagcctgggcctgcagttctcaaggcaagggagcctggggctttacactatcgtggagctaagtgagtggcagcttctacctgcctactccaggcattgacatcctgcctggccccttggggtattttgtgacgcttgctataaataccaccagtgtatgaaatgccaacttcatcctggttaagcgcacgtgcttgggggtgcggcagacttggcttcacatcttggctctgattttgcgtagctgggtgatttcaggcaaggttacttgctctccctaagtcctagtttcctcatgggccaagcaaaggatgctaatgacatggctcctccatactgaaggattcaagaagaccggacctaagacacacttatggagtgattctcataactggtacctgtgtcaacagtgaggcgggtactgctgccacgcccattttgcagaggaaaaaccttagactggagggatgaagtgatttgcccaagaatgcctagcttgtgagtgacagagcctggattcaattgcagaaagcctgccttctgcacccaagtcatcaccacttccaactctagatgtttcactcccaagtggcaaaatcatccctccatttcagctcttgcaaatctctgggcctacctttatccccgcttaactgttcagttacatctttgcctttccgatgaggctctgatcaacgctaagtcttgagatactaagttctgcacagctatcacccgtttgcctaatgaataatgaataaatacctaataaataaataatgggtaaataagcacataagaaatcaatcaaatcagctagtgggtagagagtagataaaaacaacaacaaaaaactaacagctcattgactactctttttttttttttggcatttctaaaatctctctgggatcattatacatttcacagcagcactcgaagaaccctccccatgtgggaatccagcaaactgagccatgtgataaaataaataaataaataaataaataaaccatcttctctgcaaccctaaggttcaagtctaccctgagcaaagtgaacccagcattccttggtgcacatccacagtaaatgattacttagcccacagagaaatgtctgtctgcaagactgtgttagttattatcctatcataataaaacagattatgctatagtaatgaatacgaccataatggtctgcggcagtttaatcaatgcattcttcaactgcaactgagcaaaataggtaatggaggatcatttgatctacatttttattaatttggtgtcatctgtctcctggttattttaatcatctctcattatgagaaaatgggaaaacttcctgaaaaaaaaaaaagtagagtcatcttgctctattttattcctcgctttgttttagtgtgaaaagtagcttgttccagttcagtttgggaatggaggttactgatgcctgattaaatgtagttctagatttcagagggaaaagctcccttatctcacacaagtcagacaaagctgttcaagtcatacacaagttgagacgtgttgaaagtggcctggaaccactaacagccaaatcatcatcattatcatcttttttttttttttttggagacctactatgtgctgaatgtgctgagcatggtgctgggtgagctcttctctccagtcctcccacccatcctgcaaaaggacgtaccagtatccccatttacaaatggggttcagagaggtcagctaacctggccaaaggtcacacagctggaaagaggcagtggcagactccaaactcgaagggccccgtctcaatgcctctcagtatttcttgtatgcacgaaagggactgtttgtttctcagtccccaaagacgcgctgagtcacggtagaaattatgcattcaggatactgagtggggaattatgacaaatgctttctttgcagttcctttaaggactgtgtctctcttgatatagctttctggcttaaaaaacgtttgcctagtgcctgcatctgtttacagaaaatctgacgtgttggtaaatttgcaccttgagtgtcctccaagtaacagctttagtccaaacccaggttctaagggcaaccatccctagccttttaatcacatacatcactctctattacttaatcattgttattattattattattgagacagagtcttgctctgtagctcaggctggggtgcagtggcccaactgctgctcattgcaacttctatctcccgggttcaagcaattctcctgcctcagcctcccgagtagctgggactacaggagtgcgccaccacacccagctaatttttgtatttttagtagagacggggtttcaccatattggtcaggctggtctggagatgcctttttcatcaacagatcagcatggccatgtgtggccctgaaggcttaaggttgctagatctttccatttatcttgagggaagctggagatcttgaaatttaaatacaagcatctgatttttaattattagcaactaattcagaaaattcaagcatctagcctgggcctggcatcttgctggctttagtctccatgctaagagtgaaagtgagcatgtgtagggtcttaccacctcttcttcctttacgagtctaaatggctatcaggaatcaaagacacatggactttttgttagagggactaaggagtgtcagtatcacaactgaaatggagagtacaaaaaaaaaaaaaaggctggacttggttgaggggacagtgtggaaaaactgatgtgggactgtgacctcagtgggacatcggactggtgatgcccattgtagtttcccggggctgccctaacaaagtcacacagctggggggcttaaacagcagaaacttactgtctcatagtgccggaggctggaggtccaagatccaggcgttggcagggttcgtttcttctgagggctgagaaggaagaatctattccatgcctttcttctggctcctagggaattgccggtaattcatgttccttggccttgagatgcatcacctgtctttacgtccatgttcccttggcattcttctagtgtgcatgtctatctgtgggtctgaacgtcctctttttatacggacacagtcatgttggattagggcacgctctaatgacctcactttaacttgataatttgcaaagaccctatttccaaataaggccacattcacaagtcctggggcttaggaattcaacctattttgggggatacaatgtaatccataatatctacttagcaattgagtataggattctgaaattctgaagagaggcttgatttaggtataattggcatttaggtggctgttcaacgcagaaagtaacgtaaagaacaatgttcaggtgagtcttgtttggggatttaaaagatgaaagattctaaggatgtgtaatatacgaagtttggtgcttctcaaactttaatgtccataaagtagaaatactggtattcaacttacaatcccaattattacattattattatttgaagggctccagaaggagatctgtgtttttcagtattttttccccattctcattccaggaagaagttccaaaatacattagagaaactattaatttttttttccaaatggacttttctcaccccacaagttggcctcccttggggtgactcctgccctctcctctgccttcccacactcagcaatgtgtcttggttgaagatactggttggaggtttaagatcaatgcccttcgtcctgacaggcagtgaactggtttttcagaacctttctcatgactccaggaagtgcacatgtaattaaactgagtctgtgttgggtttcagattagtgaagtgtgcctgtggcaaaaggtctcttccttcctgagagacgcagcggtgtaattagaatccggagacggattcatcagcatttcttaccagcgtttctacaggatgctccaatattcatctgggcctagttctgcttcctgggagaccatgggatgttgttgctggatgccatctgctggcaaaatgcaggggttcctctcgggtcacttgggtgacactgggggttcagtccattccaagcaagttagctgagagcccaggtaaaagtcagtagcaggctggtaagtgtctgtccttatttccaagtcagtattaaaatggtccaggcgtaaggctggctccaaatccctctgaaggtcattgttcatgcattagcagttcagcaaacatttgtagagcatctggtacatgtcaggccattccaccttcacttagcatcctttcggtgagggcagtggtacctggcacacaggctgggggatttttatcatgagctgaagtcagagcactttttcccctggcctttccattcatccaccccatccctaaaagtcaactgaaaccctggagaaacaagttgcagttattccttgttaaatctgtaatttattcccattaatcctttttgaagacaatggcaaatctgtaaaatgttcaaatacacacaggaaatagcaggccggaattttcagcttttgtcttagaacaggagtcagcagacttcttctgtaaagagttagactgtaaatattaggttggtgcaaaagtaattacggtttttgctattgaaagtgatggccaaaagtgcaactacttttgcaccaacctaatagtttaggcttttggagctgcacagtttctgttgcaaccactcagctctgcccttgaggttggaaagtagccacagatgatgcataaatgaatgggcgtggtagtgtttttacaaaagcagactggcagctgtctttggacccaggacccctgtcttagagaaatcaggttttgtgatgctgtcggaccccaataagggaaaactctaaattccctttcatggcctacaaggtcctgcatgaccagatccctgccctcctctttgtcttcagcatctatgcttcttattgctaattaaacttcagctatcccttccgccttctggctcttagtcatgccaagtgtgtggcaactttaggacttttgcaaagctgttctttcagtttcaacggcaccagtggagctggactccatccttttcagtttctcccacttctatcaacttttccaaataagtcgaggagtttacgtgatctcacaatggggtgagatatctcatgatatgaggtagggcagtcatctgctcattttctagatgcagtaatttctccatttcagtcagtgatagcaacaccaatcaggtcctctaatgaacaatccaggtgtcttcttcgattcctccccagcctcatctctacagccaacagactgccaaattctgccaaatttgcctcctgaattgttttcaaatccaacttttcctctttcttaattgaacctattgtcatttcttgcctagactaccccaaaggcatgcttactggactcttcacttgcagacttggacccctgtaattcatccatccatccatccattcatccatccatccattcatctcattcatccatccactcacccacccagtccatccatccatgatccatccatccatccactcatccagtccattcatccatccatccatccatcatccatccatccactcacccagtccatctatccatccattcatcccattcatccatccactcacccacccagtccatccatccatgatccatccatccatctactcatccagtccattcatccatccatccatccatcatccatccatccacccacccagtccatctattcatccatccatccatccatccatccatccatcccattcatccatccactcatccacccagtccatccatccatccactcacctagtccgtccatccatccatccatccatccatgcatcccattcatccatccactcatccgcccagcccatccatccatgttcctagtccattcatccattcatccatccacccatccatccatccacccaccgagtctgtctgtccttccatccatccacccacccagcctgtccatccatccatccaccaaccacccactcgctcagccagtccattcatccatcctttcatctgtctgtccaattcacttatctttttatccatccattaattgactcatcccatccatgttttcatccactcaacccatctttccatatatccacccatcttctcattcatccctccatttatccatccagtgtatctacttagtaccaggtggtgtaagtagtgaaaaaaaatatttagaacctgccctcctggatcttttagtttaatttggaaaagggatgctaaacaaactacacaaatacatgcatattaataaactggaataaatgctataaaagaaaagttttgcctgagaaagcataactgggtttaaactcagatccaaggaactgcatgaattgctgggagaggcatgagaacaggggtatggacaggaagactagcatgtggggaagccttcagctacagtctgctttctctaggggatgcaggaacagggagaatgggtgagaataaagggagataaggttgaagaaggaggtaggccagactgcagtgagtcctgaaggtctcactgacttgcaatggggaaagtccttggcaagtcttcagcagacgagccacacagttccaagtacatcttaagaagcacactctagatgcagaatgaagattcacttgggagaggcagggagcgggtatgagacgcagatgtgagcaggtaagttaggaatgtattgccacaatctacatgacagggatgttgcagaagagacagagagagaaatggacccagcagtgatattcaggatgtagaattggaaggtcttgctgctggttgaaatgtgagaatgagaactaacctttttcaagctcttcgggaccaagcctgaaccagcctcagtggcctgagctttccagaaggaaataatgctttctttaatgatgaggatagtaataagataattagcactgaacaagcacctactctacaagcaccaggtactttattatgtattacacatcattccatttaggagaacctgttggatagatactatcattagccccattttagagacggggaaaaatgaggcacacagaggtttaggtgatgtgctcaatgttccatagctgttggtagacccaggattcaactctagaaccccaatgattagaagcccatgtccttgaccatctggacaggaccatttccagtattccacatttcacaggatcctattccatgtttttggagccagagaactccggcgtagacacccctctgccaccccggagagaaacctcataggattccagacgcataagtaaagtctggaggctgagctccgctgatctgctgcagtctttattgctctacaaatgcattattaatcagccactggggtcctccccatagagccttttaaattacagttaaattccttgatagcgtttcatgcacctaatggtgcagttcctgtgttcacggcaataaacaaggggagagagggaggcctggataaccaggttaattgctctttgaggtttaggctgagaaagcaatggcaacagcacctctaaattctccaggtccctcactgcaatgctaataaagtcttgaaacaaacagcgctgtcaagccagcatcaggagtagagactacagtttcttcatgcctggcccactgccgtggcttcgctgggcctccaggtcaccttgccagggccctccttcttgggagctttcagtgtgagtgcgtgagtgcatggagatttggtttttaatggccataaaatttcagttttgcaaaacgaaaaagttctggagatgggttgcacaatcaatgcaacaatgaggagagggaggacaagaggcagcattgacgttggaactgatggggcacccctgggaacttgctgcttccttacgagtctcttactcccaggttatgaaacggttgacttttaggggatacagtgtggggaagaggcagttaactagcctatcttctggaactgtcttctccacatgctggagttggaaggtgatagcagccagggagctctccaaagcaggagtattagtctttcacactgttgatagagtcatacccgagactgggtaatttacaaagaaaaagaggtttaatggactcacagttccatgtggcggggaagacctcacaagtatggtagaaggtgaaaggcacgtcctacatggccgcaggcaagagataacttcagctggggaactcctctttataaaaccatcagatctcctgggacttattcaccatcataagaacagcaaaagaaagacccacccccgtgattcaattacctcccactaggtccctcccatgacacatgggaattgtgggagtacaattcaagatgagatttgggtggggacacagccaaaccatatgagcaggggttggcgaattatggtcttgggccaaacccagccatccattttgtaaacaacattttatcagagcacagacatgcctattcatttatgcactatctacacattgagttgagtagttaggacagagaccttctactctgcaaaacctgaactatttattatctagccttttacagaaagtttgtcaatccctatgttaaagtgtaaatcagattgtgctaccgtcttgctcaagacccatccagggctccctacgaccctagagtaaaggtcaaatgacttatctggaacaaatcatctagcctcactctgcaggagaattgtcatctgtgaaatgggagaatgaagaagcctacttcaccaatttagagcaagatttaaatgaggcaatgcatgtttcagaagagctatttttaaaaaatggtaaaacacacaacataaaatttaccgtcttaatcattttaagtgcacaatagtgttaagtatattcatattgttgtgcaaccaatctccacaactttttcattttgcagaattgaaattctacggccattaaaaaacaaatccctgtttctctctccctcaagcccctaggtctcaccatcctactcctgtctctaggaatttaattactctagataccttgtgtaagggggaatcacacagtatctgatctatggtgactggcttatttcacttagcgtgaagtcccccaggtgcatccatgttgcagcatgcgatagggtcttctccctttttaaggctggctagtattccactgtatgtgtagaccacattttgtttatcctttcatctgttcatggacacctgtgttgcctccaccttttgactactctgaataatgctcctataaacaaaggtgtacaaatgtctctttaagactctgccttcaattcttctaggtacacacccagaagagctaacttttattgagcactttctagagacagcctctgctttaataattcacacagatcctctcattctatcctcacaacagccctacaaggtgagaactattaagactatcatcattagggtgaccagataacttattatggtcagtttatgaaaagcctgccaatccctttgttaaagtctaaatgagatcacagcactgtcttgctcaaaacccatgcatggctccctaaaggtcaaacgaattatctgaaacaaatcatccagtctcactctataggagaatcctcatcaggttagagtgagactggagaactcttgagaggaaaaaggggctccattactaactataccaggatgacaggcacagatcgggattgtcctgggcaaaccagataccaatcatcatccccattctatagattaaagatcaagcaacagagcagtgaagtcccttgcacaaggtcccgagtgagggaggggcacagctaaaattcaaacccaagccgaccgactcaagctttcactgctaagcacagttctatgtgcttagcacaaggagcggcaacggtcagcaatcaatgtgaggtgtctcattatggactcttcaggctggggagaggggtcttcaggacgcaaagggtcatcaagggctgagaaagtcagaggggtgagggggaggcttttcacacccaggagtgagactgtggatgccaatgtgtccataccaaatgtgaacttgccccatggagagaagcagatgcccaggtctcccaccatgcttggccacggcaccatggacattttggactggaaaatcattgtggggatgtcctgtgcattgcaggatgctgagcagtatccttcgtgtctacgctttagatgccagtagtaccccctttcccagtcgagacaaccaaatgtctctaggcatgtccagacgtcccgaggggctcagtagcattggttgcaaaccactgaatcagggaaagggcagaactagggggaacaggatgttctcccaggtccgggcttctcaaagtgtagttctggagggcagcagcctctggcagaagtgtgatttctcaggttctgtcctcgacctgggtcagaatccctgggggtggggccttggggggtctgttgccaacacaagcccaagtgtggccggcaagcactgtccttgaccacgcaagaaaattgctgggatctcggaggactaggcacgagagatgttactaacgtgaaacctgaagagggatcccaggcagaatgcaggatggaagatgaggatgttttagaggctgtcaaggtcctgttggtgaccaatacaggatatactgttataaccaatacaggcttttcacagggcagtttgatgctgtctatcacaatttaaaatgggcaagctgtttgacctgccaattctattcttcagatgctctgtagcagccagtctcaactcaggatccccaagagaattaagctcgaatgtcctggggcatccgttgtaggtagcaaattagcttttctctgatgtatccagaatggtactagttatgtacatctttgagagatctgagaaaacagtcacttagtatagtaaaaaactggcaacaacctaaatgtccctcaataggggaatgaccaattacactgtggtgtatccatacccagagttatatggtcagctactataaagaaataacttaggtctctagctccaggcaaggaaacagacctcagacctggacatgtgcaacaacaacaaaaaaatcatctaacttgtgaattctttcatcccacagccagatactattaatatattttttacaagtttcagatttatacatcagtttcatatgatttatgaatctcttgtcacaaaaccacactcttttttttgacatgtgttgagtttagatatctaaagaaaaacaaaaatgtacacacaagtgccactgctcagatgggactgacggatcagggtggattttccccttatctgcaatgtttcagtattttaaaataatgagaatgtatacagccttgacttgaggaattagattttaacaagcatcctttctgcattatttgggcaagttcttaaaaatcgtgaggagaattctcctttccctgccttctcaccatcttttcactttggtcgctgcaaatatcaccggggactggctcttggcagcctcccagttcctctgaaaggtttctcactctatccatgccacacttggaggtgagctattaatttgcgctttgtggctcagctcgattctgatttagggcaacataaaccctcctcaaaattgcgaagaataaattagtttactaatttcgccattaagagtttatcaaagcaagcactatttcaatcgtctcttaatcaatcaccattttccgtgtttatctcctgttcaatttttaccagagggttctatacacatcaatttgtctgatgttcttcctacatatgttttaaattactttatcattgtataaatttcacagccattaaaaggctctaacaccagaatgactgacatggtgttaaaaattgaattcaattccacggggtaataaattgtgacctaaatccaatctctcatgggtgactgaaggatacaatgaaaaattattgctttgtcatttttacactaacacaaatataccacagcaactagaaactggcagagaaatgggaggtaaccgcggctggctatttctcaccccaggcaatgaactgacttcaaacacaagtccttagcgtcttggatgggattggcgcccccgcctccaaaagcaggtgaattatctgactgtgtgggtgggtctcattgcaacagacagattgagcacaaggagcaaatgtaagctgcaaagggcttgcttcagcctgaatgcagctgctcctatagacaccaaagtgcagtggttaagccccttgccacgccactggaaccaaagtctctgagctcagagcctggctctgctactggtgaaatgtgtaattctgggtaagttttctgtgtctcaacttctttgaatacaaagttgttatgaggaataaatgagttaatgtggctaaaccttcttaggatagcccttggcatttaacaatccctacgtagaggttaagtgttattatttaagagcagtttcttgtatagagaccttagctccctgttctttctggctgcagagatggagagtaacaagtatcaatagctagagaaaggtgttgattaacatgcagtgcattttcctttatctctggagaagctagatcagtcatttaacacatctggttccacatttactaagggtaccacagagcagacaagttaaggtgtgggttttgaagttaggcagaagtgggtttgagtctaaggtctgtcacttgcaaatgtgaccctgggcaagctacttaacctctctgaggatcagtttcttcgtctgttcaatggaactagagaacatcccttctccagggctgtgcaggagtcgcgatgagatcacacatgcaaagtgctcgcctccacacctggcattcaggaagtgcctaagaaatgtgggttctcgtgtcctagccccgtgcaggcaggggctggagatccagtggtggagactcaggatatgctatagcagccagtctcacctaagggtccccaacagaattaagggtactcagcccttgtggctcagtgtgggctacagagcactccagcaaccacgctatcctgtgacatgtaccccagcagggaacaggcaaggtggtttgggggcacacagcttgagcacctcacacagacttggagaggtgcagtgtggggagacagcatcacagaaggcttccaggaggaagtggcattgatatgaattcctagccctggactgccaagtaatttgagagaggagaaaaggccagctagttttgttgacttatgcagaaaggagagatagctagtcttttcactctagggcttatttcattcattcattcatttattcattcactcattcactcattcattcattcaagggccatgtctgggctccttccttcttgcactaagtctctgtcttggggaccctgggtggcagacacacaatcagttgtgcccaagggagcaagcctctcatggagcaagaattctatgtgctcttcgaatctccattctctgccttgttctggggcagctactgggcaagaactcatggaacgccaagaaaatcatcacaaaccaccctgccatggaagcgagtctcccatgcccacctgcaggcttccagaaccacaagagctgccaatcgagaggtggcctatggctgacttgtaacaggtgcttggtaaatatttgctggctagaccgatggattaatgaaagtacactcaaatacggtattttattcagcaacctgaggaggcaggggaggcccttgtgcaatctgttttataggaaagacgtgaggctcagagaacacaagtgccttgttcaaggctttcgcagccgataaagtggcagaggggccgcaagtcttttgagtttggttcaaaggcttctcctaatccagggtcaggtcaatgatagtgaaacagcccaggacactgagtctatgacattgctggaggcactgaggatttccttccatggcttggatgtcatgagaaacagcactgtaagaggaggaaagacctcccaaagatgtgtaccctaaatccagggctaagaacttgggggcaggggttgctttcctgatccaagatgacctcttgttcagggctcaaaagtggaagaagcatgattctgtagagagaggatgtgagacctgccccccagtcccagcctgccagacccttacctttggggctgatatagtttggctgtgtccccacccaaatcttaaattgtagctcccataattcccatgtgtcatgggaggaacctggtgggaggtaactgaatcatgggggtgagtttttcccttgctgttctcgtgatagtgaataagtctcatgagatcagatggttttataaagaggaatctccctgcacaagctctttctcttgcctgccacactataagatgtcttttgccttccgccatgattttgaggcctcctcggccacatggaactgtgagtccattaaacctatttttctttataaattacccagtctcaagtaagtctttatcagcagcatgagaacagactaatacaggggggcctaccttcccctcaggtctctggcaatttcagttcagtactgagagatgcctctacctccattctccttgctcaaagcaaagacacagatcctctaaacctagcacttttaggaattacaacttggcctacgagcagattaacctttttgcttataggaagagctcccctgttggtcttgtgagtgttttaaactatcaacacctctgcctacccgagggcctttgcacacgatactcccttgacctggaatgtccccctccagcttttcctctagttaactttcaccacccttcatctcttagctcaactataaaacacaactatgcaactccccagaattgctgttgcaattttacatgtgaattttttttttttttttttttgagatggagtctcgctctgtcatccaggctggagtgcaatggtgcaatctcagctcactgcaacctcctcctcccgggctaaagcaattctcatgccttagcctcctgagtagctggcacccaggtaatttttgtatttttaggagagatggggtttcactatgttggctaggctggtatcaaactcctgacctcaagcgatccacctgcctcccaaagtgctgttattacaggcatgagccaccgcacctggcctacgtgcacattttaatgatcgtttacccctgtgtttccctacccaactttaacaggccacaagctccctgaggacggggattctatctgctttcctcccaaatgaatccatccaaactagttcctggcatagacaggggatgctcgatgactaattgttgaatgagggtatattgaagggagctggtgacaaacagtttcaggtcccaggtggtggatgccatgctcagaataccacctccacagagattctagatgcccatttccattgctttgcttggtgcacacaggcctctgtagagaccccagtgtgaagggaggttgagccactgaggctaaaagcaaccacgttatcttctttcccagtgagggcaagactgaggattatgatgtgccaagcacgagatattcaaagatgagtacgatcaggcccctggcaagtctttccccaccatctaaaccaatgtcaggcacaaagcagcctctcaataaatattaaatgaataaaggaattcagcatatccaaagactaggaactgttccatttgcaagcagcttaattcttagcaagttcttccacaatgagaccaaatctatttctgttccttctctaggcacctatgtagtttttttgtttgtttgtttgtttgtttgtttgtttgttttgagataaagtcttgctgtgccacccaggttggagtgcagtggtgtgatctcagctcactgcaaccttgacctcccgggttgaagcaattctcatgcctcagcctcttgagtagccgggattacagacatgtgccaccacacctggctaacttttgttttgttttgttttagtagagatggtgtttctccatggtggccaggctggtctcaaactcctggcatcaagcaatgcacccaccttggcctcccaaagtgctgagatcacaggcgtgagccaccacacacagcctgtaggcacctatctaaatggttccccacctcacctgtcctctcatcctgctcaacgtcttcaaataaatcatagagtcatatccagacattagattgcagatgtggctattcacttgtcacctctggtctctcctattcaggtagaagctccatgagggtacagccatctagacgcccaattgatttccagaaccaatggacatggtactcaagtggcacaaggtgttctctgctcttgttcacagctctaactccaggtcctagaacaaggattggcaaaccacagcctgtaactatctattttggcatggcccttgagctaagaatgggttgacatcttaagtgggtagaaaacaaatcagaagtagaacagcatttcacaacaagtgaaaattatgtgaaactcacatttcggtgaccataaatgacttgaactgaagcatgcccacaatggtcatttgttgatgtgttgtttatggcagctttcacgctacaatggtaaagttgaatagctgagacagagaccatgcattttacaaagtcccaaatatttatgatctggccctttatagaaactgtgtgtgtgaggccctgtcctggagcacagccttgaatgtggtggctgaccaatgaatgggtcttctgatgttctctggatttgccagtctcttgcctttccccagcaagcccaaggaagacctttgggactagttttgtccaactccaatgaactgttactggatacctcttccttcctgggctcctcagaaggagatgccaaagggcccagttggaactgcaagggccgccttgggaaagcccgtcaaccccacccacttagccaagctgttcctggtcaatgtggcttcatcacatcaccctcattagcgtggtaccttttaacttttcacagctattccctcattttctcatcattggtgatacagcaaaggatctgggagaaagtagtatctctggctgacaaatggggaaactgaggtatttacctgggaccacttgtgacatccccagttctattttccctccactgcggctgtcagctacgctttctagaagccggctactcacgctgtgtagttaccccactgcccccagggcaggagggatgtagaagagactgcccttaagcagctggcagtatcatctgccagtctctctctgcagcgagcggccagccttccccccagaatccccatatccaaaaatccattcctgcaaaggctgatgggtaaagacggtttgttgctgccacaaagaacccccttctgttcatcctcacccctaacacctgtgccagcttccccagtcatgcgcaatttcctttgcccatcacccattggagaactgccgacttcactcagatgcccagaccggggttccccactcaagtccaacccacccagctcccagccaatcatcttccctggaacttctcacatttttcatttctaattcttcacctggatgtctagactgcagacccacaggtcacttacagcatctatgtggtggcttaaccagacccagcaaaggggaagaaatgcaggagcaacgcaaggagccagcagggcctttcttgggacattttaactcaagacacagagaggctggtggccgtgagggccactgcacggagggcgcttcctgacatgcaggtgttcaaaatgtaatgaggcagaaaaagctgtgtcacctggcagctggcacagattgcctcctatgggtcgcaggtgaaacagcctttattggaaaagatgctttgacaatgaaaggggcagagatgcacccttcacccaggatccatgtgttccctgcaaccagggcttctggggaagaggtggtcctggaaggcttcccagaggaagcgcattcagggtgggatctccagaggcaagaggtaacagccaaagtggggtgagtgggagttgtggggacagggagggggctggggaggactggaagctactggggctgtgtctgaagagcagacccagcaagacgtggctgcacaatggctgacaccatcaaagaaacccttttcctctcctctcctttcctcttcttgtcgccccttcatttagacaactcctccattgcgacgattaggttggtgcaaaagtaattgcagaaaaaaaaaagtcattgtggtaatactaacaagccaagcacatccacttaacttccccagtgcactcagcattttatatgcattgtctcatttcagccaaccacgctataaagacagaagatgagtttttgtgtccattttactgtgcagactgagtcactgagcggttagggttatgtcatgagtaacggcagagccaggaattaaaccccattgcccaagctgtccttgactttcaatctgacctggttcattgccctgaaacactaggggttccagttgaatgaccagagaccctagggtgtgtggctcaaaacaaatttctcggaggccatcactgggggtgatgcagcagagtcccttccccacacctcactgcatctccctctgcacggttgccagtggacagccagaggaatccctcttcccctcgtgaaaacagctgtcaccgaaaagggatggagctggggcttccttctaaatcccttttctctggaaagtaaaggagaaaagtcccgagagcaaggaatgtctcacagaaagcaaaccatctcctgggcttctggactcgacattttccctgagtggtggtggggtgaggggacagagagcgtgagggacaggaggagtgggggcgctgtaccaaagtcaacatttaaaatctatttctcttcccctgaatttttcagacttgcagccatgaggaattgtttccttaattatattcaacttccagcacactcttggctgaagtttaggtgatgttgcgtaaagcaaaatgagaaacacagggcatccatctgtgtgtatgcttatatgtatatgaatatttactcatatattaaatttccctccacccctgtctccatctcctcatttagcaaagaaataaaaggaccactgggctgaagctcaaatccctcctaagcagagggaaatctgggtgtcatggtttccagaaagggaacacaatccccgtatggggtgtaattacatcttagctttctgcagaagaatagtttatggcttaaatgctattaattgtaagccgttttgttccatgggaagttgttcattgataactacccaattagggttattttgcaattagtctattcacagtaaatttattgcaaatgggggagtctgtggtgtagcaaattaaagcgtcgctgaggctgggtgtgcaatggcttttaaatgccaatcttattaaccagctcacaggtcctgggagggtgcgctatcctggccagtgcactaaaggcctcaggacaaactccggcaaactcacactgcaaagccatccggagataacctcagcatgaccaggagaagtgcaggaacccctggcctaagatgctgaggttctgatttttttgaacaactgtggagcagtcataaagcaaatagggatgcaatgtacattagcactaccaggtacagttcttagctgtgtactaggcccttggaaaccctctaagctaagtgtgatgatgctcatctcccctttacagatggagaaactgaggcacagagaggtcaagcaacttgcccaaagtcctacagcttgtgcacgggacacctgggattcagatccacgtggtctgcctccaccaccccaggctcttaagcactgacagcatcagcacccctggcttcccaataatgccctgccttcttctcccttgcaacttgagagagagagagagagagagagagagagagagagagagcgagcctgcaggtggaagaacacctctggggcttgacaatgtgagataaagtgacccttctgcctccccaagagggacaggcttatggaaagggatacaggctctgtaacatgagttccagtaccagctctgtcatctgctggccatgtgtttctggccaaggactccccttccttgagcctcgatttcctcactgacaaaaagggttcacaatagactcagcctgtagggctggtgtggggacacagtgtgacaaggcagtgttgcacatattagcacaggtgacccttgaacagcacaggtttgaaccacacgggtccatttataaacagattttcttccctcctgccatccctgagacagcagtaataccaacctctcctccttcttctcctccttttcctcaactcaacataaagacaaggatgaaggcctttatgatgatccacttccacttaatgaacagtaaatatactttctcctccttatgattttcttaacttcttttctctagcttacttacatttatttatttatttacaattttttgttgacagagtcccgccctgttgcctaggctggagtgcaatggcacaatctcagctcactgcagcctccacctcccaagcttaagcgattctcctgcctcagcctcccgagtagctgggattacaggcatgcgccaccacacccagctaagttttgtattttcagtagagacagggttttaccatgtggcccaggctggtcttgaactgatgacctcgggtgatccacctgcctcggcctcccaaagtgctgggattacaggcatgagccaccgtgcctggcctagcttactttattataagaatacagtaaataatggaagtaacatataaaatatgtgtttatcaactgtttatgttaccagtaagctttcagtcaacacaggctattatcagttaaggttttcagggagtcaaaagttgtgctctattttttgactgcaaggaggttggcacccctaaccccagaattcttcaagggtcaactatagacagtgatagcattttgcagggttaagaaaactaaaagcccaagggccaaatccggcccatggcctattctttctttttcctttttttctttttcttttttttttttttttttgagatggagtcttgctctgttgcccaggctggagggcagtggcatgatctcagctcactgcaacctctgccccttgggttcaagcaattctcctgcctcagcctctagagtagctgggattacaggtgcacaccaccatgcccagctaatttttttgtatttttagtagagatgaggtttcgccatgttggccaggctggtctcgaactcctgatctcaaatgatctgcctacctcagtctcccaaagtgctgggattacaggcatgaaccaccacacccagccagcctatttttataagttaggtttaatgggaacatagcgcatttgtgtatgtgtggtctctggctgcttctgccctatgacggatggcagacttgaatagctgtgacaaagactggcccccaaatcctcaaatgcctaagatctggcccttcacagaacaaatgtgctgtctctgatatacagaaggagctcaatatttcgttcatggaatggcattcaactcaggcctccaaaacttctccaccaggcacaggttaacaaaagatgctggaaacgttgcactccacttaattattgctacactctgtgtgccaaatctaatcaagaatatagacaggaaccacctcgaccacttagacaagggtgaaacagcaaggcagaaaggaagcttttctttctaaatctttctatttaaaagtatcgtgtaggccaggcactgtggctcatgcctgtaatcccagcactttgggaggccgaggtgtgtggatcatttgaggtcaggagtttgagaccaacggggccaacatggtgaaaccccacctctactaaaaatacaaaaattatccaggagaggtggcaggcacctgtaatctcagctactcgggaggctaaggcaggagaatcacttgaacctaagagttgaaggttgcagtgatctaagatggcaccactgcactccagcctgggcgacagagcgagactgtctcaaaaaaacaaaacaaaacaaaacagatagaaaacaaaagtattgcacagacacatgcttgctactagaaactaaaataatatagatgcacttgttaaagttgtccctgctgccaccctgtccctgcagatgggggggccataaggaaggtttgctgtctatccatccagccctctttctgtgcaatgagtgtaggtggccacctcctatttgatctaaatcctctattctgtgaccagtggtaaacacagaggcacatatttaaaatgaaaaacacctctaattaactgggggacctggcataagtctcctcccctctatgagcctcatgttcttatctgtccagggaatcgaatgaagagttctcaccaggcgcggtggctcacccctgtaatcccagcactttggggggccgaggcgggtggatcactaggtcaggagttcaagaccagcctggccaagatggtgaaaccctgtctctactaaaaatacaaaaattagctgggtgtgatggcgggcgcctgtaatcccagttactcgggaggctgaggcagggaactgcttgaacctgggaggtggaggttgcagtgagccgagatcatgccactgcactccagcatgatgacagagtgagactccgtctcgaaaaaaaaaacaaaaaaaagagtagcgaatgaagagttctcttaagaggtctttttagtctacttttctggggagccattctcttgctgcacttcctttcttcatcaagagagttgggtgaattgaccatttgccttctcaggaggacaccaggcaaagccttgcatggctcccggatgcaccgatgccggtggaacggaaagcccttcctccccaattctgcagctggcttgattctctgactttatgccttgacattgagcagcacctcagtggatcccttccagctgcatctgttgaccctgacacctccccaatctccatctagctcgactctgacatgcccccaaccccatcggagcccccagagctctctgttgcctccttgctggcctccgtgctcatttaagggtcttttcccttcggagataacaaaagcaggggttggtatttggatttagaagcgacaagggggtactgtgaacctttggccactttgtgagggacagctgggctggccttgcagtgtggcccaatgagaaggagggatggccaggagtaaagagtgaagtaggctcccagggaaggtggagcaaaaagacccctagaatgcaagctgctccctggacagataagaaatctaggccctgagagcagaaaggactctccctgttagctggtagctgagcttgaatgaaatccacacccgtttatttcaaatgcattcctctctgtttgttgctagtggcaccaactcttcgtgggaaggtgccttttggatgctatccgccctctccacagagaaaaccactgagcaaacgaattcacaaacattttgagaatatcttctccaaggaaaaaagtaaaatttaagagtgctcccagaggctggattatcgtaagctatggtggcaggggctagcgggagggaagggggcgtgccctaaacaacagtgaccacgagtcaataaacagcgaccacgtggctgggtgatggtacattggggttctctctactctgagtgggtccgaaatttcctgccataacagtaagcttgtaagatcacttaaaggccatgtgaccttgggagagggattttacatctctcatctgaaaaaaattgggctcatgacatcagcatcagcctcagagagtgttggatgtgataaacaaattgactgcacagagcctggtgcggtgtctagcacacagcgaagcctcagcagccccctgtggctgctgtcattccccttccaagggcactagagaaggtgaaaatcactaccaagaaatacacatcaatggcacgattgcacatgcgctagtgaaactggactccccatcttcagatggcccctccactctgcctgtgaatttctggatcagagcttggatccctccgtgtctcagcaagagagctggtttatcatcaggtcatccgcacataaaagagtgccagtgaagggaaagagggaggggaaaagcaaagagcaaggaaaggtggaaagaaggaaggaaggaaggaagtaaagaatgaaggaaggaaaagaagaaaggagggagggaggagagaaaaattaggaaagaagaggacagaaagcaggaaggaatgtagaagggaagaaagaaaataggaagaaaagaggaaaggagagagaaagaaaattaaaataaggaagaaaggaaataggaaagaaggaagggggaagagaggaaaataaggaagggaatgagaagagggaagaaaaggaaagggagaaacaaaccaggaagaaaatgaggaaggaagggaggaaaaagggagaaagaaaataaaggaatgagaaggaaagaaggagggaaacaggaaacatatgaggaagaaagagaagagaagagggaaagaaacttttgatgaaggaaaacggaaagttacagagcctctgaagttaatgcaaccaattagaaacctctcaaatcataatcaattacaataatattcatatcaattctaatcccaatattctactgaaagagaaacgaaaccatatcaatacagctcccttggctcctgccagcatcacatcagctcccgatttcactataatttcatcctttgccataaaggcaatgggttaaagcacctacaaaaggtaatctgattttgcaaaatttttctgatacaagacttcaacactcagggagtactagaacacatcagatctcgtgtgctcatctggggtttggaaaacagggtggcctttctcagaaggtctgagaaggtgagcagaatggggctgggcaggaggaggaagtggccaggagatccctctctgagccagcggggttggaacttaccctcgagggggcagaaccgagtcaccttctcaggcatcagcagccctaacttgtggcggcagtaagtctccccaatctcctggcggcagtgcttggacttagcacgggacagggcagagatggcctccttgcctgagatgtcacacttagggggctggtcatacttggtctcgggggagctgcccccagttttcctggcatgaggcggtctggacacatccttcccgtggctgctgttggctgcggctctgtccccgggaggcagcacctcaccggggcctttcccagggaatgtatgtccttttcctttctcctgctgttccagcttccttttcaaaagctccttctgtctactcggtggcttcttcgccaactcaggctggtgcttctgcttttgagtcctgggtgcgaagttgctgttgtcgacattctcaaagtctttggggacagagttctcgttgttgctgtctgttcgcactttctctttcggccgatgagaaaagtagccatcctggagaagaggggagagaaacagaagagaaacttgactgagagatcatgctaagcagactggcctttgaagagtgagtcatacggacttggaagccggggccatagtttcacatcctacttttgctactggtttaacctctggtaagatggctctctctggacctcagtttccccatctggaaataggagatgttccaaccagaaaccaaggctttttcaagctctaaagtgccatgactacgattctcaatgcttcttattaaccacaccttttcaagtcagtttctttccttgactgtctttgccactgggtaacaaacattttgttccagcgtcccgtttaaattccagctgaaagtgctgtgatggtttacttaagggctggaaatgatataataaagttataaagggaaaaatattggtaggatattacatacattccattgcctttaggacatgctcatatatctatgcccataagagaaatcagactgagccgttgtaaattctgtgggaaagaaaccagccgcaattttttttttttttttttaagaggaatgcagcccttgtagaataaactttacactaagtcctggagcaaagcaaacttgcgacactcttgtgcttgagtttggctcttcatgtgtgtacatggaacagaagtgatgaagtcatttggggtcaagacaaagatcaggagtcattctggagaccacgcatggcatggatgtttccagaagggctggaccccaaactcagctcctccatgggtaaatgggtcctggttactttgatcagtcgaatgatcaaatgcatcattcaaccaatgccccaaattgtttctgcaacatgttgcttctgcttaaagctcattcccaaggccttaatctgaaagcatatccaatgtcctacaacacggcccctgacctctgaagccacagagaagagtaatggctccatatagctgcccttgttgctatggaaacacaggggcaatgggcggcatccctgctagtcctccttttaaggagggctgaaatatgcctcttaccagttcccaaggaaaaaggtgtcggggcctgaacagcggatctgcaggggtacccaagagcagctgaccctcagcaaggctcccaccccagcaggtcagcaaacaactgcctgtgttttttataaataaagttttattgaaacacagccatacctgtccatttgtgtattgtccatggctgctttcctgatacaatagcagagtgaatagttgcaatagaaactttctggtctgaaaagcttaaaatatttctatccagccctttaagaaaatgtatgcagacccctgctctgctggagtgtgagttaaaaggcctcctcctctgggactgggttagttgcttctgtcctcaccatccatatacgacttagtgatggcctggagaagaaggtgcccctaggactgggcgtggtggctcacacctgtaatcccagtactttgggaggccgaggcaggtgaatcacttgaggtgaggagtttgagaccagcctggtcaacatggcaaaaccccatctctaccaataacacacacacacaaaaaatagctaggggtggtggtgcacacctgtagtctcagctaactcagaaatctgaggcaggagaattgcttgaacctgggaggcggaggttgcagtgagctgagattgcaccaatgtattccagcctggggggagagtgaaactggctctcaaaaaaaaaaaaaaaaaaaaaagatgctcctctagcctctgctccattgctcctagcagtaagcacgaatttctcctatttgttggaggctctgacactaagacaccttgtggccattctgtaagctgagtactgctatgactttcattttgcagatgggaaactaagcacccatgaacaagtgacttgcccagggtcacccagctagttggcggtgaagctggaattcaaaccaggcagatcacagaccccacactctgggctaccagggacatgatccacttccaagaaattgtatgatccttattacacccatcacccaaaacccttaagtactgcaagctgacactgaaccacaagatctggcccctcccacccagctaaatgaatctgctagaggtgtgtgacctccaaattgcaatcttcaggctggctagtggcctattgtgttgcaggaagtcatatagagacagtaagcagcagccacgaagcacgtggagtctgaggctgcaggagctgggaggtaacaaggtaggaagaaggaaaaagaaccaagaaaaaaacagctgaccagtccatattgggtcacagggcggctactggttgtacacaggaactgcttttatatcctgacctataaatgagggccttctgcttctggtctttcttattctccacagatacctacaaaaaaaatccccttcagttggtacctagagtacatctttattcttgtaacctaaacaaaacctgctgatgttcctcttttccctttttttctatccagaggcccttgaagagtcccaagcagcctctcaggcgcattttctgagctcttaccatgagccaggcaccacagtaagttattcacaggtattacttatagggtactgacaattggatgtatttatcttgccattttatagaacgaggagccaacgcttgttgtgatacattcttcactatggatcacgtgctaggtgccatgctaagcccttggatgcagtacctcacttaactcctggaaataatttccaacgtaggcactactgttcgcccaccttacagaaaagggtggaaaataaggttggggatgtcgagtaatttgcacaaattcatgttggggaggcagcgaacttgcatctgcctgattctaaaatctgctattgtatcacgcctcttgtgttttgctgagaagtaaatcaagaagcattcagttcccctgcagtggaataatgggtatcaccatctttgctcatattagcgtctgtcgggatggagctgatggggcaggggtggcattcaataaagctatgaaaaatcatttctgttccattccttctagggatgtgttaggattgtatgtccctatcccttgtatattaggcacagacaggaaacatgctatggccaagagcagtgactggaacccataaggtgtcattccctggataccacaatatccagccacactcctgctggtggaggtcatgcatccctgagtgaggcccatgtggagtagagactctaccaaccctcagtgtgcagaaattgacccctgctgctttgagtcactgagatttgggggatctgtgttactgtagcatggtctaactcatcccgattaatccaggagctaacctgatctcctttcttcctttgagctgagtcaggtacaggagccaatttttttctccctccaacagacagaaacatctattgacgactcccatgctccaagaacataaatttaaattctgtccctaagcccattttctagaagtttctagaaatgtctaaagggcagggagtaagccagaagagctactgccctgatggacatcttcgttttctctcttcagacatatcctaagtgtcattctggggcccttctctttccttgttatcagcaagtttccccgccacacaacagaaaacctccacaaacccccatttcaaaagctcctgttctccatcactttctggctgaactttgccaagcaaaaccagacagaaaacactgcgatcatctccctccaccccccacggccaatgaagctaatctgacaatcagagaatggccaattcctctggctaatgtgtaatatcaggaagaggcaccaccattgattctgatgggactcatgattaatacccgctctctactcaagacaggccaccacaatggcgatgattagcttgtggtggccctgtgaacttctgcctggccccagatgctactcagctgccatgggaacccaaaagatttgagtataagagggaaggaaaatattttgtcttctggaacaaaagggctcacagatactagatcgcttccagaaaagtcagagagaggcgcagtcagcgagaattggaggcctgagaatttctgtccctcagagtcactgtcattttctatagtgactgcggcgttctctctggcttccccccttcaattcatttttttcttttcttttcttttttgagatggagtttcactcttgtcacctaggctggagtgcaacggcgccatcttggctcactgtaacctccgcctcccaggttcaagtgattctcctgcctcagcctcctgagtagctgggattacaggtgtgtgctaccacgcccggctaatttttgtatttttagtagagacgggttttcaccatgttggccaggctggtctcgaactcctgacctcaggtgatccacccacatcaacctccaaaagtgctgggactactatgataataacacttaacatgagatctaccctctgaaccaatttttaagtgtgtattattgttgactatgcagctatagtcaacactatagtactatatgcaacatacagcaaattgttgtatattgttgcatgtactactatattgttggctatagtactgcacagcaggtctctatggcttcttcattgtgcatgcatgattgagatgttatgcctgtccatcagcaactccccatgctcctccccaatcccccaactcctggcaactactacttcactctctggttctaggattcggactattttcgatagctgatagaagcagaataaacacgtgtactatctgtccttctgtgactggtttctttcagttagcataatgtcctcagagttcatccatgttgctgtatgttgcaggattttcttctttttgaagctaacatccattgtgtgtatatgccacattttctttatccagccatccaaggatggacatgacatatcacttcatgttccccctaactcttcatctgactgccaaggggcaaacagattttggcttttctgtcctttctgtggagactcaagatccagaaagccaaacccaggatcccttcccttcacaaaaccaatcttgggaggtctccaggcagacccataaaaaataaccatcatatgcccagcacccaagtggcccatgctctgtgtcctttgaatcttcttgaaaactcaccaaaacagacagtattagtactccttaagaggaggaaactaacatagagagaggttaaataacttgaccgaggctacactgctagtaatgaagtgattcaaactctctgtgtctcagtttcctcatttaaaacattgggatgataacaccttggtatccatggggatgataataatatccatctcaggccgggcacagtggctcacacctgtaatcccagcactttgggaggctgaggcggtcggatcatgaagtccggagatcgagaccatcctggctaacactgtgaaaccccgtctctactaaaaatacaaaaaattagctgggcgtggtggcacgcacctgtagtcccagctactcaggaggctgaggcaggagaatcgcttgaacccaggagatggaggttgcagtgagccaagatcgtgccctgcactgcagcctgggtgacagagtgagactctgtctcaaaacaaacaaacaacacctcacctcttgggtaattcagtgaggaagagtgtatgtaaaactactagaatatgcccaccacacaaagctggaagaagaatgagcagtaaaccagactggggaactctaccaattaacactctctctcccctgacagtctctgcctagaggacagatgggttattatttcgcaattgtgatcaactggcatcatcttctctactcttcatcaatccaactctctcaccttgagttatttatgctaatgcaaccctttgacttactttattttaatgtacttattacaatgattgcacattcaaatgtttgtgtgcaagctccaaaactctaattgctctgctgttgccttacctctaagctgctgctagaatccatttttattctggagaaataattaaatgcaataatgtcctccattcccattcaaccttgggcatgtttagagtcaatttcaatcaggtagaaatatgctaaacataatatggctccgagaagcaggttacctgacccacgctgctgctgcaaagacacgtgggtctgtttccatttttcccaggttctcttggttcaggatgaatcaatacttagtctactgaatcctggccccttgctcccatttctgaggggtgggggtgggttgccgtgatttttaaactatccacctttgctcttattgtttatgtaggagaagacctgggtactagtattgcattagctgatgtccaattttcttatctgtaaaatgatgtgtcccgaatgtgtgttactaaccattctgagttagttattaatcaatatattcaatgaacaaaattctgccacttcagctcattaaaacaattcgatggaccttaagagaccaggaactgaggacaaaatggaagcttcaaagcgcatcccgtctgcagccctatccctctattatcgtctatagcagcacactgagattcagaggtctggactcaggaagaagtgagtttgattcctcccttctccatttgctggggttcttcaagctgggacagaacatttcgcctctctttgcctcagtttcctcatccatcccagagagccgaagatggcacctacttcccagggactgaatcgatcaagcatagaagatagtgcctgacacgtccaaagtgcttaagaaacacgtatgtcttaggttccgttccaagcctgttgcatgtactaactcatttaatctccatgatgagctgataaagaagacgctatattttctacccatttttcagattggaacattaaggttcagggaggttaaatgactaagtccacacacctaggaaacagaggagccaggatttgaacccaggctgtctaggtctggaggtcatgcctttcaataccccactgcctctccgcagctattaggaatagggacagggccaaagggaaaccccagccaggtgcactgctcacacatgagggcgcctggcccacccgctcatcgtgatcagtttacggcttccttttgtgccatgtgcacgcacagccggctgggtagttatttggtgttgaactcagtgtccgaggcttcgttccaatcaccaaggctaccaaggccactgggagggacaaacagggagaggcctgcacctgcttccaaaaggacctccgtgccagggtaggcgaacggtggaagcacagtgtgtgtggctgtaccaattagaacatgcaattacccaggctgccaatgcaaatagacctaacagaggcccctcgtccagctcatctgcatgcacaaaaggtggctggccagcacttagaaacccgtggaccacgctggacgcaggcaggccctgctttaacagaaccctaagtaaaaagccctttgcaatgtagcatcatgttaatgggatgcaaaacagcacagggtgaggcaggaaggagtgagactgatagggctgggttggaatccagtctctgctccttaactctgagacggagggcaagaggtttaacctctcagagcctcatttttctcatctacaaaagaagggggtaagaagacctactttgcaaatgtaaggtggggattaactaatatgtcatgcacatataattctatttaacaaaacaacattgggtgagaggcttgatacatgttaagcactcaagtggcagcaggatgatattttaagctagcgccttgtcacttgatgagcaagtctgagtcttttgtttgtttgtttgagacggagtctcgctctgtcgcccaggctggagtgcagtggtgcgatcacgctcatcgcaagctccgcctcccgggttcacgccattctcctgcctcagcctcccgagtagctgggactacaggcgcccgccaccaagcccggctaatattttttgtattttttagtagagacggggtttcaccatgttagccaggatggtctcaatctcctgacctcatgatccgcccgcctcagcctcccaaagtgctgggattacaggcgtgagccaccacgcccggccaagactgagactttttggaaaggcagagtgttgaggcacagtgggttgaaatctggaccctggcctttgctcactgtgtggcccagggcacagtgcctaactttgtctgcctcagtttccttctctgtaaaatggggacaataatgagtacccaatctaatgaggctgttatgagaattaagagtcaatgaatttaaaacacttaatacctagaacttaataaatattaggtataatttattaaaatagaattaatgattgcaatggtgacttaaagtggttcttaaagtgtggtctgggaactgttgggggtccctgaggccttctcaggggatctttaatgacaaactattttcacgataatataaagacattattttcctttctcgcttactctctcatgagtgtacagtggagttttccagaaactccactgcacgtcatactgcatcagaaatcagaagcaaatgtgagaatctagctatcttctattaagccaggtgttacagagatttgcaaaaaatgtaaaacagtgcctcccttcttcctaaatttgttttcgttggggaaaaatatgcatacttttcataaatatattttatatacacaagtaataggttattatgactgtttttaagtgaattaataaacattttaagaatgccttagtttaaatattactatataggaagtaattgatagcacctacctaagccaaagctctttggtgttcctcaataatgtttgagactatacagcaatcctgagaccaagtttgagaactactgacataatacataagtacaatcagaaatatttactgattattaaaattaaaagtttaggattcttttatgtaggctgttttgctacatgccaagccttttgatttgtattttacttccatacacaatacacacacacagaacagatagaaatcgaagttgagtgataaatactttttttttttttttttttctgagacggagtttcgctctttgttgcccaggctggagtacagtggtgcaatctcggctcaccgcaacctccgcttcccgggttcaagcgattctcttgtctcagcttcccaagtagcacggattacaggtgcccgccaccatgcccgactaatttttgtatttttagtatagacagggtttcaccatgttggccaggctggtctcaaactcctgacttcaggtgatctgcctgccttggcctcccaaagtgctggaattacaggcgtgagccactgcgcccagccgataaatactttcctatagagagaggaacccaggcccctcaagtcctgaatcatcctcagggaggaagaatgacctgctgtcaagagttagtccttgatcaaactctagtcagcctcctctgccccctttttctactgggcctctcagctttacctataaagacttgaatgaaatgctaacgttgtttttctttttctttctttctttcttttttatttatttattttttgagacagggtctcattttgttccccaggctggagtacagtggtatgatcacgactcactgcagcctcaacctcctgacctcaagcgatcctcctgcctcagcctcctgagtagctgggactacacaggctttcaccactatacccagctttttaaattttttgtagagacaggaccttgctatgttgcctaggctggtctcaaactcctaggctcaggcaatccttggcttcctaaagtgctgagattacaagcgtgagctaccacgcctggcctgaaacactaacatagtttctcacagctcaaggcaacatccctgggatgaccccagctcctgcttaaagtgactgctttagaaaactcaaggctgccaaaataatttactgtttgttccagctaacacctctagacagggcatcatctcccagcctctgtaagagagcaggagccacacttcataaacagcagttagcaaacccatttgagtcacacatagaccaaccctcccttcctgcttttggtaattcttcacttccctgagtccactgagctcatctcccttccctccctcccacctctctccttctccctttattattattattattattattattatcattattttgagatggagtctccctctgttgcctaggctggagtgcaatggcatgatctctgctcagtgcaacctccgcctcccgggttcaagcaattctcctgcctcagcctcctgagtagctggaattacaggcgtgtgccacaatgcccagctaattttttttgtatttttagtagagatgggatttcaccatgttggtcaggctggtctcgaactcctgacctcgtgatccacctgccttggcctcccaaagtgctgggattacaggcgtgggccaccgcactctgcttccttctctctttaaaacacccagtcacctctgaacaaatccaagttgagttcagttccatgctggatgcttttcctattgcaacaggcattactgattaaatgtgcccttacccctttcatagggtctggctttgtttatgtttgacgcagcccaaggccacctagcctggacctcaagcctacaaggctaagtccttggggtaaaaaccaaagagcccagcaaagcgtgctcagagcccagcccctgacttaacccactcccctcttcccaaccccaccagggggacatgacagtgacagtcacagcgctcagagcacccaagggactgcaggcaggtggcagggaaagatctgaactggcatctcctggctctttccctatcagcataagagacagctgtgtggtacagagatacacagcagagggcgaaataatggcagaggagaaaaagacgaaaaggaaggaaatgcaagagaaaatggaacgagaagaagaaacaaacatcagctattgtttactatgtgctgattacctaccaggcacggagctaagcccgtggcttggcatcgctattcattcctcaaaattatctcaaaaagtaggtcaggggtcagcaaaacaccctaccacctgcttttgtcaataaagttcttccaggacacagccatgcccattcgtgcacacactgaaggtggtgcttttgtgctaggacggcagagttgtgtagctatgacagagactacatgcccagaaaagccaacatctggctctccgcagaaaaaatgaatgccccttcaaatggggccagtgaggctgagccaggcttgcccaaggtcactcggtgggtaagaggcagggtcagaagtgacgcacaggagtcagactccagagacaacatgaggttgcaaagtcagacccaaggacagagggagagagagcagagccttccagaaatgacaacaaccatgtctgttttggaacaaaatgcctcacacacagaagagcttttctatggagagaggcctcctaactgttttttgtttgtttgtttgtttgtttgtttttaagtgtcccgaaggctggcctcttcttcgttactatttgaacacagtttgcctctaattaattgcagcattccattgcgttattccacagttatggccacaatacccaaagatccagagagaaagggggtgtggtagagacacagagagagagacacacagagaaagacacagagagagagagacacagagagacaaagagagagacacagagagaaagatacagagagaaagatacagagagagacacagagcaagagacacagagagagagacagagagggagacacacacacagataggcacagagagaatgtgaacaacccagtcttgctttaataataaagccttctgcgtacctctcaggcagggtttctcaaggacagcgctgttgacatttggggctggataactctttgttttaggggctatcttgtacattgcagggtatctagcagcatctgtgagctttacccactagaccccagtcatgtgcccttgttacaaccaaaaatgtctccagaccattgtcaaatgtctcctggagtaggagtggggcaaaatcaccttcccacccccgacccctgctgggaaccagggctcaagggcccatactggccgatctcagctgctcaaatcctgttcccattcagaaacagcctttctttccctcattttccaacagaaacagaccctggcatccagccagagcagtcagaataggagagaggctggtatgaagagagctggctggagaaagggccagagttaaccaaggaagggtattccagaggggacagagggaggaggctggctggggtgaccagggagaaatggcagctgcatgaggaaagcgggagaagttagggttcccgctagggaaggatgacacagaagaggagggacacattcatttgggcagtggatagtctttgagttgatggcatgtcttttaatttattttttgttgttggttttttttttttttttttttttttttgagacagagtctcgctttgtcacccaggctggagtgcagtggcacgatcttggctcactgcaacctcggcctccaaggttcaacaaaatcctcccacctcagcctcccaagtagctgggattacagatgcgcatcaccatgcccggctaattttttgtacttttagtagagacgcggtttcaccatgttggccaggctggtctcgaactcctgacctcaagtgatctgcctcccttggcctcccaaagtgctaagattacaggctttgagccactgcgcccggccatgtctcttaatttaagccagaagccacaaccgggaccaatggctccttcaggcacacaggtgtctggttcactctgtagactgttttcatttgtttaacttaatctcggcccacatttcaaaatctagagatttcatctaaaactttggatttctgccccttctggaaacatcagggacctgacaacactgagcttagatttctacgcatgacagttgtcttgaggctaagtagcggtcccatggtctccagaaggggcatctgctctgtccggcccggccagtgtccccttagccctctggcatgtctgcacgcggtgacactgcttcccaccaatgacacaggctcttccgggaggccttctacctcctgagctttgcctcggagatctcagaaccccaaaagatccttgtattccagagtgtttgatggaggtggcattgtccctaatgaggtgttctggaagcgtgtggtggcatttccagttatcacaatgattgggggatgctgttggcaatgagtgggtgggagaacatcagaaacccagcaggacaggggaacactcgtggctggacaatgaagagctgtcctgcatcctgcacatcttctgaacgtccccagatgtcctgtgcgtaaacaactcatttataattatccaggccaggagcctaacttagatttacatatgatacaacattattatgaatggttttaacatagctgaattttctaggaaagtaactactgtttcactcaagaagagattttatatcacttagtttgaccacagtttcagaaaattacatcatcaaaggccacacaagctgtggctgtgagtcaccaacacacacatccattccccgcctgcatttgtaactactgaattctcactgactcaatacgcagtagctgacctcttcatgtatcctccagccccttgcaaccaagtgtggaccactggccagcaacatctgcatcacctgggaacgtgttagatgtgcagaatctcaggccccagcctggaccacaggaatcagggtctgcacattaacagcatccccaagcaattcgtctgcacatcaaaaattgagaagtacgccaggcatggtggctcatgcctgtaatcccagcactttggaagtccgaggtgggcagatcactggagttcaggagttcgaggccagcctggctaacatgatgaaaccctgtctctactgaaaatatcaaaattagccagttgtagtggtgggtgcctgtaatcccacctactcgggaggctgaggcagaaggatcgcttgaacccgggaggcagaggttgcagtgagccaagatcatgccactgcactccagcctaggcgtcacagtgagaatctgtctcaaaaaaaaaaaaaaaaaattgagaagtgctaatgttgttgcacccatcattcattcggtcagtcagtcagtcattcgtttattttggagacagggtctcgatctgtcgtccaggctggagcgcagtagcatgatctcggctcactgcaacctctgcctcccgggttcaagtgattctcctgcctcagcctcccaagtagctggaattacaggtgcacgtcaccatgcctggctaatttttgtatttttagtagagacagcgtttcaccatgttggccaggctggtctggaactcctgacctcaagtgatccacctgcctcagcctcccaaagtgctgggattacaggcatcatcatttaaataataaaacatattatctgtttataaattgctgtcatatatttcttcttcatactattttagcagtctattgatcttttttagagttgtgggtgtttaagtaggatagaataaggctggatttcatttctggttgggtgaaaggaatgttttaaaagatttgtgacattgagcagggctgggtctgctggggttaaaatcacaggtttattcattccacatatgttatttgggtgtccactccctgacagatggggcaggggaaaaggatataggaaggggaactaaagtatgcttcctgctgttggtggaattctgagaaaagagaggaaagtaagtatgaatataagttattttaatataggaccaaaagggagtgtagggatgggtgtgctcaggatttgaatttcatcaagggtgtggagcctcacatggtctggggtccaaggagaatggaggagacttcacagagaaagcagttttccagcctcatcttgagaagaaaggagcaagacagacaaaggaaaaaagggctttccaggcaagggcaaagcatgtgcaaaggtgtggtgagaggaccagcccaactccttttataataacaacgatcccagctaacacttagtgaacatttactctaatgactgagctacacactttatatagattatctttaaaactctcagagcagggccgggcacggtggctcacatctgaaatcccagcactttgggaggctgaggcgtgggaattacttaagcccaagagttcaagagtagcctggccaacatggtgaaaccctgtctctactgaaaatacaaaaattagctgggcgtggtggtgtgcgcctgtaataccagctactcgggaggctgagggaggaaaaacgcttggacctgggaggtgggggttgtagtgagccaatattgcgccactgcactccagcctgagcaacagagggagactccatctcaaaaataaacaaacacatcaacaaacaaaaaaccccagaacaactctattgggtaggtgcaattagtatccacatttcacaggtgaaagtatggaggcatagagaggttaagtaacttgcctcaaatcacacagcatggttataaacttacattgttactcctgtgggctgttaacaactacgcttggctcagtgccccacaggtttctaaagtcccccccaggaggaaacaccacttccaccaaaggccctggaagaaagcaatcactaagtgagctgatctttggcctggggtggggaagggaggagtccagaagtaagagagttatctgaaaagcctgggttcctggtgtaaagtcctcttgcctggctgcctgtgattcattctctacctctgttatttgagattcatttctaggttggtgccacgcccctgactcctgaaagccacaaaccacaatattctatttgtcccctggttttatttccctatacaccttctctgtctctcttgattcaactcccaggaagccctcttgtcctaaccatcatccttcctccccaacattctccgatccaggtcctctgggacggggcacttaaggagacaaatgggtctcctgctgttgaaaaacacccagttttcaaactcatcctttgcctgtgtgggccctatcccccacacacaccctgccacagtgggtaatgaatggttcacttgtaagctcattaccgcagggcctctaaagaaatggaaatgctcacggagccagagacataaataaggagaggcgcctgtaaataaataaatatagatgcacatacacacacacaaacccagttaatttctatcatctgaaagccggaaccatttggggtggggagagagagaaagaaataggctcctaatattgccatccatgtgatttcagaactgagcttccccagaagctgctaataaattatttttactatgcagaggtacaaatgaatatgctgctgtcaccccctaaatctcctttatgagcatgtgtttgccttggcccaacctactggggacaggggcttccgagcaagttttcattggccaagttcctgaaggaggctgccatcttgaaggtctgctctctgtaagctgcgggtgccccactggcacttcctgtttatgcctgaggttggcatggcctgcaggacatccaatgtcgattggaaggccacaggaatcaaagtgacagcagtgcctacactcaagcttttggaaaatgatttctgcagcctggactgagagctgctgttcacaagatggaatgtacccctcttggccatatacttcaataggccctgacattttctaccaagtttcagggtggatatgcaaaaacctcatcactaccaactttcgcgtgcactgtcatcatccagaaggaaactctggtcactccctttggaggcagtgtatccaatgtccagttctccaactgttcagagcaagaagtaggccatggaaatcatggtgatcatgatatgctaccaggacacgatgggcaccgtccgatgaagttgttataaatgtatgccctggagtcactcttgaggatctgaaatccagctctaccacttcccagctgtgtgacctagggaaagtcgtttaccctctctgagccttgctttcctcctacgtaaactatctataatatcaaaacctcgcagggctaaaaagatacgctgacttaaccagtgcaaagacacagttcagaatagttagcagttaataaaaggtagcggttacccacatcatttcatgcgaactcctacaacgacttttcatacattcattcacagatatttactgagtgccaagtacatcttaggtgctggggacatgtctgtgaataagacagacagatgcctgctcctatcgagcttatattttaatagcatgagacagacaaccatcctaccaacaactcaataaacagattctatcacaatgttgggcatctgttatctatttttatctattttatttttataatttcaacttttattttagattctggggatccctgtgcaggttagttgcatgtgtgtattgtgtgatgctgaagtatggagtatgattgaccacttcacccaggtagtgagcgtagtacccaatggttagttttctaacccttgtccccctctagaagttctcggtgtctactgtcaccacctttttgctttttgtttttccagacaaagtctctgtcatccaggctggagtgcagtggcgcgatctccaatcactgcaacctctgcctccggggttcaagagattctcctgcctcagcctcctgagtaggtgggattacagggatgcaccaccacacccagctaatttttgtatatttagtagagacggggtttcaccatgtaggccaggctgttctcgaactcctgacctcctgtgatccacctgcctcggcctcccaaagtgctgggattacaggggtgagcccccgggttcaacctactgttttcatctttatgttcacgtgtactcaatgtttagatcctaattccaagtgagaacatgtggtatgtagtcttctgttcctgcgtcattaatttgcttaggataatggcctccagctgcatccatgttgctgcaaaggacctgattttgttcttttgtattacccactgttcccagatgtgggaactgaggctcacagcggttatctcagcaggtttatgagccagagttgtcccacccaggagagttttggaagtgagaggagcaaccagcaagagaggccggctgcctggctgacaggtaaaagctttgtttcctcctcctcctgcccctcctgccatgattgacagagtgagacgcctccctgcgaacatgaggcatctagttcgggtagacagtttgctactggagaagttccttattcaaggggctgagcagtagtggcaccttttcgtgtatgaccagccagccgtgcccagacttctgaagtctggctggattcagacaccgaactccctttagtcctcaaaggacccatgaaacacccaacacaaggtggttccaagagacccggtggaccgcagttgttcaggccactagatggctctttctgtgaaatttgcagagagcaagccggcagctgcaccttgatactgaagccgggctgcttccctttggacagtcaggacgcatctccgagaagttcttcttcattgccgcaggtgggtgggtcactacctcttcctttaaggggtattcccattaaggcttttcacttcagaggagtttgacaaggcgagactgggatttccacactgtctactaaatcaaagtcattgccatcatgcaactttctgctaactttcccagcttcaagggaaaagtggagcttcatggagctccacttcatcatctgttggcttcacatcatcccatcagagacaagctccatataacagcatctactgtttacccaagattttgcacgattctcttgtttcatcctcccatttatctttggtggagatattatccgatgagatagaaaagtaaactgtggcacagaaagggggttacatgactcaggcaaagtcgcccaggaagcaaggggcaaggctgggatccatcctaggtctgattctgaagcttgtactcttcactttacagcctcatctatgcacagggaagatcctcctgagctctgcaagtgtccaaacttagaatgggcaaccaaggctgactgtgaacatttccttcctggttgggctttaggaagagaagcgaaatttgcctattacctctacacacctcctgagaccaggagaatcctgggtgacaccaggcattcaaggatttcatgatacagtctctccctccctaatgcacctttcagcgttgctactgggacagcatttcctgtgcctttttaaatttaatcctcttcacagccctctcaagaggcagcgcggctctgtgatcaggagcatgaatgctaaagccagactacctgggttctcaacttagccgtgccgttttgaagctgtgtgaccttgggcaggtttcccagctgtagccagctcatggagttgaaatgagaattaagtcaatgttgggaaaacacttaggacaaggcctggaacacaaattgtagctgttactagtatgatcattaatagtagtatgtcctttttcaacatttgagtaaacagaggctcagagaggtgaagacacttccttaaggccacacagatcagggatttaagccatagcaccagacctgggagccaagctaatattccctctccaacacagccccttcaagtcccaggctggaagtgagctgcccttcttagcagtgaaacacctagaaaattggctgacaatttatcgagggcgtcttcaacaagtgtgtcattttggatacactgtgggctaactattggtgcagagagtgggctgaggggtcagcttcttcagcatctggcttcatccatctctgggtcattgatggcttctgtcaagatggccaaagaagaccacgagagtcaggctaggcctcctcctctgcatattaattacagccaaggcaaaatgtggccacagcagcagttaggggacaacaggaccctgcaagtcctcaagcagtcaggcagaggacaccttgggcaccccgccctctgcccagcacaatcttccgtggcactgccgaggacctcagcaagatgcagacctccagggatgtcagcctgtctcctcctctaggtctgtcctctttctgtccctctgtttgtccctctcccctctctcaaccacctctccatcattctgcaatcaacatcctgcccatggtcagggatatctaaaaagctatccaggctgggcgtggtggctcatgcctataatcccagcattttgggaggccaaggcaggcagatgacttgaggtcaggagtttgagaccagcctggacaacatggcgaaacctcgtctctaataaagctacaaaaattatccaggcatggcggcagcacctgtaatcccagatactcgggaggctgaggtgggtgaatcgcttgaacccaggaggaagaggttgcagtgagccaagatcgtgccactgcactccagcctgggtgacagagcaacactctgtgtcaaaataaataaataaataaaaagctattcatcttctgaagaatggaggtggtcagattttgtcttattttctgaaacatacttcaatattttcctaatacaaatatgtgtcagatataaaaaattccaatacaatctagatttatgaaataattcaaaatgtattaaaatgtacagaaaaataatacagtgcccttccatgtaccaattttgttatgttttattcaattatttaaagaaattagactttgcagagacaactgggaagttcctcccagctttcaaccaccatctcccaacccagaggacacttctatccttcacattcatgtatttatatttttagttaatacgtatgtgttcacatacaatgtatagtgttattttgtgtatctgtaagtttgacaaaagggcaccgtgctgtaaatatctcctttgcgtttgcttgtgtcattcaatattagcatttctacccccatctcctctctccttttattttctctcttctcaattcttcttccctcaggtaacatgatgcagaaggaatgacagcatttagttcaccaattctcagccttgccttcccattggactaatctgggagccttcacaaaatgcagatgcccaggtgcccacacgggagatactggtttagtgggttggggctgggcctgggaatcacgatttctaaaagcccccagacagcgaggggtaagcaactggatttggcccctctttcagctttgggtacctgctgtgaatcaaggtcactcctgctcagaggccaggtgaaggaagcatctgataggctggcctgcagcatccaggggagcggctgaaggacaggtactagagctggaggcaggcatcagagccccagtgcccggtcacgcccggggttgtgactctgcttggctccatgcagcatccaggggagtggtggaaggacaggtaccagagctggaggcaggcatcagagctccgttgcctggccacacccggggttgtgacactgcttggctccatggtactctgtggaccctgctcccaccatctgtaaactgagtgtgctgggtgagggcagtacttcctaacacttcctcccttcactggataattttacttggctcacatttaaacataaacatttatgttgttaaaaaaaatgatggtcatgattcctaaaattcaaacaaaaggaaaaaggaacaatgctatggaaccctggctagaccaagttgcctggctaaggctctgaacccagagagtcctttgtctgttgcacagggaaatgtgtaagtgttggcaaggtgttaaggacatcagcaccgtgctgagactttctcattggtttaatccaagagattgcaggagcactggaaaggcaatcatttcctccctggatgattcaaagttatttaatatccacagaatccccgcaaatcatcttgggtgccaccgtgggccacaaacacttcttggaaacacatggacctgggtcagtccctctggtcccttatcacatggatgctgtagggttctatggttctatgggccatacctgagattccattacaggggaatgtcactcccctcccttctctctcagtctcccagaatggggatggatgaagagatccagggtgagctataattcccctcacccagccttaatctggctgtcttcccggccagagctctccaggcaactccactttctacctccaaataatgatggtagtactaagtgcagcactgactgtatgctaggaactgttctaagcaccctgcatggtctagtccttttaaacttcatggcagccctagggggcaaacacagtcagcactcctatttctaaaatggagaaactgaggcacagggaataaaataccttactgaagaccctcaccccagcccccgacttccctaccccctggccagtaagtagccacgaacaactgtactacaatgcccttttgaatggcgggggtgctgacagctgtctatttgctctaaagatgtggctgcttcagggagcaagtgagcagggggagaaagaggaaaagcatttttagaaattatttccgacaggtgaccacatactaaaataacaacatttggtttgccttgctagctggaggcaaaaatcggctcaggtgggagggtgaggctgcaggctaaatgcagacaaggctggcttgccctgagttggcccagttctaggaagggcaccggcatttctgccattaattgatgcactgggaacccccagcttggttttctttaaggagagaaggagctgggtctttcatggtgtaactgtgaaaatgagaacctcccaggggctgcaagacctggttgtatatggagtccagtgagctattttagggacgaagtgtaaaattgtggaaaacagttgtaacacaggatggggtgtgtgtatgaatatttttattgaaagcaagaatatttactgcatacttactatatgccactgttgtaagggattaacctgcattacactatttcatccttgcaaggatccttagatatagctactattgctaaccccatttcacagacaatgaaactgacacacagcaataagtcaccccccccaagtcacacagctagtaagcagctcgttcagagcataaaatccagggctcatcacctccaaacttcacatattgcatgcatagacccacatttccagaacgcctaagaaattcccagtcatccagcacgagtggatggaaatgaaggggcacatcccgtcctcgcttggaaggaagaaggagctagccctggaaaactgacagactggcacgtctggaggcaaagccaagccaacgggagcagatggagcccaggcagcagatgttaatacagtttgctttttccatatgctcttctgtttagctgtaataagtgaattgttctttaatatctgtcaggagctcaaactctgaaggccgggggcagtcacagtcactcaaaaagacacaaagggaagctggccagccgtctcttcacatcccagaggaagggtgcagaatgtgaagaaagatgccaaacacagcaaagtccaggtctttgtgtacacacacacgcatgtgcacacataggcacacacgcacacactcctcgcctgccatgacagtgagattctcacttgacattctagagtctttgaaatcctgcctcagcgtccttcccactcagtaataacaactaagtagaattttcagattttgcctttgaaatgacaacaatgaaagacccaatttgaaatgtataaagggctccaacggctttgctccttgggacttccaacgcaaccacaactcatttccttaatcaagggcagcagggccactgcagaaccctgtcttctgtcttaggatacttcacgtgtcttgggacatccagccccatcactattatcacataggggcggggtgtgatggtgacgtctgtgaacagtatttcttcaacgatatttccatttgacaaccatgaattaggactctcatatagtctcaccaacttcatcttctttctaagtatccagctgtgatactgttatccgcactaccactatacacccgcccagtcagagaataaacacagagggaaggtcccctggtcctcacagttccagctcaacatagagcagaggttgagttctgagctaaacctcagcattatcccttaaaatccacgtgaccttgggcaagttacttctgacatttctaagcctcagtttcttcatctattaaatggaaagaaatagcaccttcctccctcaacagtcctgttgcgaagatcaaatgttaagaaatgcaggttaagtgttcagcacagcaaccggtacttagcaaacacttactgaggagcagctactatttttttattattacttctatttctcattcattcattcatcccactaacactggagcaccttctaggcaacatacattgtgctaggtgctcagtagtgaacaaaacagattcagctcctgccctaatggaacttacattctacagggggagagataatagagaaataatagttgtccaatatgatatgacctggggatgagtactttaaagaaagataagacaggagagaggcagcggatggcatttcagatggggtcaggtaggaactctctgaggaggtagcatttgggtggcccaatggtaagatggagcttctccaaacacataccgggcaaaaggtaccaggcagcaggaatggtaaaagcaaaactctcacagctggggatggtgctgtgcacctgtagtcccagctacttgagaggctgaggcagggggatcacttgagcccaggagttcgaggctgcagtgagctacgactacaccactacactacagcctgagtgacggagtgagactctgtctctaaaaattaaaaatttaaaaagcaaagctctcaaggcagaaatggtctaggaccagtctagcagcaggaagaggaagatggggctgtgatatggagaatagactcatacagcacaggaaagcaagatggggctgaacctgggtacacagagaggagagaagtccgtatctcattctaagtgcactggggagccactgggggcttaagcaggagagcatgccagatctgactgatggatcctggaagagcccactcacccactgctcacagatgcagagagaggaagcaggggcagaaacaaaggtggatgcagccctggccaagtccagactgagatcagaatgcattgcctgggtgctgctccagcctcttctctccggggtgttgctggggagggatgagggaaaatgcacaagtgatgggaatttacttagaagtttctggctgcaagcttgggtgactagaatcacccaggaccccatggtagtgatgatctcacaccagcaaatggctttaaatcagaattcaaatgagtctggtaaaccaggataaagtgtgtaatttaaagcatcccggaagccctgggaacttgcgctagatgcttctcgatctgctctcaggggatctccagcattattctggagagatctggtagcagaattaatgactctggcatttcccacctgatctagggctttgatccttcctgccccatgactgtctcagaaccaaaggttgtgggacaatgggcactgtgcatgtgcccagaccaagaatcagcatttaggcctggctgcaaatttcaccatcatgcccgggggccctgctttctgctgatgtttcagccaggaatgccaggcccttcacccctcaccctggcttgcattcaaatgacccctgcctctgtctccttcaccagactttctcctcctcctctatgcctacagaacacttttaccaactccactacagaactttccacctgaattgcttgttaacatggtatagccccctaaaaatgtgtccttctgaggagcagaacttattcaagtttataacccccaagggtctagccccaaacctggtgtatctctgtgtgtgtgtgtgtgtgtgtgtgtgtgtgtgtgtgtgtgtgtgtccatgtgtgtgtgagtgagtgagagagagagagaaagagagagagacagagagacagagagagactgtgttatgccaatatcaacataaacagcagctaacacaatgggggtctgggcccacgtgcctctctgctaatcactaactttcatgatcttctctgaccctcacaataaacctgtcatagaggatctattattactccaaacatacttagactcaaaaaggctaggacatttgctcaaggtcccggcactagtaattggtaggactggaatttgaaccaggctcatgtaagctcataaatcaagacccttctccaccacacttacttgaaggggtaaacagagactgagcaatatgtgggaggagtgggtgggaggctggggagggaggtatggaataaataatcatggaaggggatggcagatggaaattagagaaattaatacatccaagaatgttctcagggttttggtcaaaccatggactgactcaccaatataaagaccactctccttgtcatcccaaaccattcaccttcaagtatccacggatctgcactgtcactttcttagcccaggtcaacctgtcacccatgtggatccttgatcaacacagcactaaaattgtatgtaaaactggcttagctaatactcattagctagccacacttaggcacattacgtatattagcttcttgaatcctcacaacaatccccatggataggtatcatcatcatcctcatcatcatcatcctcatcatcatccccatccttgttgtaaggttttccagcaagcaatggaagacggggacttgaacccaggtaatctgccaccttcaccacaaagtatagccatcgttgattgtgtccttacactgctctaagcatctccccatgtcttctgctttaagcaaacttatgagatggggagtgttttcattccaattttacagatgaggaaacttacgttcagagttcaaaccctgaattctgttcaggtgtttggggaggtcaaacccaccaaacaccacccagccaaggccacgatcattcactgatcctgcagctttatgagaataataaaaaagattccccttactctgggcaattgcagccctgagtctacagtatgccttgatgaccagagtgtaggtgaattttggctcctacttaactccctcctgtagttatatcctgaacaagcatacgcagaaacactgcagccagctaaaaataggcagaactgagattcaaacccaggcctggcgtggatctagtttttcatcatgtagatgctccatcacccactcagacaccactccccctctttttttttaatccagttcaagaatcaacccaatccaaggctgctcaattaacgctcagtgcagtatcctcaagcaggcaaacgctcagaacgtagacggatccctctagatcatactcctcccacctcctggggctgtggccacttcatcacagtctcagaaaaaactctgggctcacagaaggtaactctgcaccatgagacaatttgtcgaatccttgcagccggtaccgcatgtggccaaatctccccaccccaatcaggcagccacttcacacagtgacctttcctgatctgcactgtcaggctgcaatttagccattctgaggactctgttggaggctgcttcagccaaaagcttgcctctggggagccctcccagggccctggactccgttcagatgtcactttgcattaagggcccactgtgtggggctcctggagaggaagaaagcaaatctctgctgaatgtccctaagacagaagtcaagtgaggagcaggggaggcaaaagaaagacagacagacagacgctgggcatctaaagaaggggtggaggactggtagttccaactggcagcagaaataataataccaggagcttaacatttaccaatcacttaggaaaaaagattaatactaagtgagagtttaagatgtgccaggaactctattaggcataatttttctttttttttttttgagacagggtctggctctgttggccagctggagtgcagcagcataatcgtagctcactgccacctcaagtgaggctcaagtgatctcccacctcagcctcccgagtaaatgagactacaggcatacaccaccagctaatttatttatttatttgtagtagaagatgaggtcctactatgttgcccaggctggtctcaaactcctgagctcaagccatcctcccgcttcggcctcctaaactgctgggattacaggtgtgagccactgggccccacctagacataattcttcaggtgggggccggtaacagttactcctcccttctccaatataaaaatagtgcagtgtccaagcagagaggctacaagataaatcaattgccagcaaaacccttggtgtataacttagctatacagtttcactcatggcaagagtaacggcagctgggatttcttacttacctcctacctgtcagggattgtgtgtgattcttttgttcttcttggggcttgtcttattatgcttattgtagaccgactgtactgatggtcccaagcaatggcctgctgtatgcttgcccttggcaatgtgccctgctgcttctcccaagaggttgagatgacttgtccataccttgaatatgggcaggtcatgcgacctgctttggccaaaagaaggtagcagaggtgaccctaagtttggcttctctgtcttggaaccctgtcactgccatttgctctctactggaggatgagagaccacgtggaggcgagtccaaatgactttcctctcagttgagataatcctagaccagcttagaggcagccaatctccagacatgacagcccaactgagatcaggagaaccaccactgagaccagaagaaccatctagctcacccaaagactcttgaacagtaacaaataaaaatttcttaccgttttaccccactgagtgttgaggtgatttgttaaaacatcccaagaatacaataaatagatttttttaaaaaacctgagcctcagagacataaagtcacttgtctaaggcaacccagctgataagagatggagctgggattctacaccattgtaagttttcatccacgatgatctatacctagggtcaagaaatcattttctgtaaaggactggctaataaatattttaggccttgtaagccatacagtctctgcctcaacctctcaaccctgccattgtagagtgaaaccagtcatagggcgtatgtaaatgaatggtgtgctgtgttccaataaaactttatttctaaaaacaggtggagggccagatttggcctgtgaatggcagtttgctacctcctgctctaggttgcttctctgtatcatcaccatttgtgccagcttttttcccctttctctgtctgtcgcctccctctttccctcctctagaatttccacataaaatcccgcaattgtcttctgccatgtttatgttctaccctgagacatgtgacaagtacctctcaactcaaggggctttgtttccccagcgtaagtgtgtctcaactccctgatttcataaatctatgtcatttccagaaatcagtttgactgatgtgttttcccaatgttaggatgatatctttctggattccctaggtatgggaatttaaaaagttctgattgcattccaaatccaagacccaacatcatcagggtgacagttgagaatgcaaatgactcctattcagaatattaaaaacaaaagcttcagttctgtacctaggaaaatttgactggctccaaaaaaaagtttgcaaaaaaccaaaatgaaaacaaaacaaacgcaaacatgcaaacaaaacaaaaccccaaacccagagtgatgcagaggaaagtctaagagctgtttcatgatcccacacaccccgtctctggggcaacctctctgtaagaagcaagaaaggaagatgacgatgactttctgcagagaacaaaaatttggcttgaagcaaatgaaatcccagtgattttccattttaaggatatctatctcatccaaaaaataaaatgttataatagatttcattttttccatctctttcttgttctttttgcctcttagctgtcctacttagaatatcgaaccgtgttggcaatcaaagtagactctgaacttggctactttctcctcagttaaaagaaaaagaaaaagaggtagacttgagtgtttagcaaagcagctcatccagtttagaggctgaaagccacatcttcaaaatttcaaccaaggaaagttagggttagtgtcaaactttccataatttttaacaactttctaagtaaaactagagatgtctatctggactgactttaattttaaaagtctaaagcaccaaaggcagcggaaggtccatctcatgtttcattacggttaaattctatttccaagaaccaccaacctcagtcccgggacctggcatggatgaagctatttctggaggctgccatgactcttggagccaagaacaaagtggaaggagacgccttacaggcaggggccttcaaccgcatggaagtaccagcagatcctgtgttcagaatcccctactgtactcttagctccccaaactgttgaatcgacccaaggaggtgtcaaagcctaccatggagcatgcacttgtaaatgtctgcaaatgacatgggctttctctgtgttagatgtggaataatcactactaacataattatctccattataaagatgaagagactgaggccaaagtccaaggcccacagctagtgaagggcagagctgagattcacagccagctcatctgacttcagggcctatctgaaacatgacaaaataactgacttggtaaatgatcctattaatttgggtgatcagatagaggtggttacaatgtcctggggtggatcaacaccctggctctgccaccaaatcctgatcctcctcaggccacctgacaattgtcttattttattcatttatttatttttgagacacggtctctgtcacccaggctggagtgcaatggcgcaatcatatctcactgcatcctcagcctcccaggctcaagggatcctcccacttcagccttctgagtagcaaggactgcaggtgcacaccaccacacctggttaacttttttttggcagcgactgggttaatatatgatttagtgggcaccaccacacccagctaactggctatttatgacttttttgtagagaagaggttttgccatgttgccacagggctggtcttgaactcctggacccaagcgatcttcctgctttggcctctcaaactgctgggtgtgggtgtgagccattgtgcctggcctaattgtctcattttaaaagaactttcattcaatgagcagcatatgtaagatgtgggacctgtgaggttggcaggctgaggttatttcccattacacagatgtcgaaactgaggcccaggggtcctgcccactgttacccacctggtagtggcacagtcaagtatgaacaacagatcctgtgtgtccagcccagaaccaatagaggggtttggatttgggtggggtggaacacacccacctcaattttcccagcctctgtctgttctaaggccagaaatcctctgaggcccctgagctgtgttttcctaaagctctgaaggtcaaatacggtgctgaggacctcacacttagaatgtgctgagaaggggtacaggaatgaaagctgctggcttaagtgaaagacatatacaaaaagacctggaaattgtattttatcgcaatagctatttattcctgctgttcggtgttacaaaaatgccatgttccaaaaaggcttaaacaaaagacactgttccactgaccaaaaattaaacagataaaacacagtgtggggacgaggtgtggtaaggaaaggaatgaagagaaaagaatatgataggatggccaggcacggtagctgacacctgtaatcctagcacttagggaggccgagacctgtggatctcttgaccccaggagttcaagaccagcctgggcaacatggcaaaacatcgtctctacaaaaaaacccataaataattagccagctagccgggcatggtggtgcccactaaaccatacacacacacacacacacacacacatatacacatatatatctgtgtgtgtctatatatatgttttttgaaaggttctaaatattatatatattatatatacatgatgggaaattcaatttgccaccagaagcatttaaaataataccataggttttatgagagatatgacctctgtctctgagcttatgagacatgtgagagatatgaattgtctttgagcttcctagcaggcaatgcaaagagggaaacacaattagttatttgaatctgtgtcacagacgagattcctcacttcacaaaaaaaactctcccatctctatttttttcgtgttattatctcttgattgtgttctgtttctcacatatcagttccatctctgtatttgctgagctgatctgtgtatccaaaatgacctgctgtgcagggctcttcacaatagcccctgaaattcagagaggctggctgatgtggatccctgtacagctctggtatagtcaagtgtttatttactgagcgtcacctgaacagactggcgatgaaggagaagtttaaaaccactttggtaggagacgatgccaccagaatagcaatgggaaatgaagcagagaaatccctggcattaaagttgaagtgaatgagaaaagcacatttgtgttgacatcatccctgttggcccacacatggtctttcagaaacactttcctgcacaaagtggggcacatgggaatacagaggccacttcctcacatctctccacactttgcccagtcccacggtcagggatgagacgttcatccacttcatctcagccctgagcactaagggggccacagtgggcagggtcactgtgtgggagcctcaggaaccaggactctggcacatgctgggcagctccatgcaatggaattgtaagctgagttgggctccctgcaggcatgggagcatttcagagccaaaattcccacctgcagctacaagcaaagagagtggaggtcctactttagctaacccgtaaagcgggcacttccaagaagacttttactggaactctgtgctagaagattgggaagttgattctctgtcggctacccccactgctgcctaggggtcctggaaggttgggaggggaggagaggtgactgcaggacagggtatcatggcatccccgagtttacctccaccaaacacacccaaaacctctgtttaacacccaacaactagtatttaattttcattccgctgacctgggagcatctctctaatggaacttccacttagcatagccactgaagttccccagggacagtggtaccaattaaataacgtgacactttggaggtgtaaagctatgtatttactcccaaaccagaggcttgggtagtttttaacataaagattttctccctccttttttttttttttttttttttttttgagactgagtctccttctgtagtgcagcggcacaatcctggctcactgtaacctctgcctcttggcttcaagtgattctcctgtctcagcctcctgagtagctgggattataggcacccatcaccacacccagctaattgtttgtaattttggtagcgacaaggtcttaccacgttgcccaagctggtcttgaactcctgagctcaagtgatcctccctcctcggatgcccaaagtgctggggttacaggcgtgagccaccacgcccggccagaatctctctcttaagagtcaccactagtgcccaatgtttactgttcagaaaggtcattgcccagcagttgcaggcaagaaaccctggacgcatcttggggaaatgcatctaaacaatgcagagcagaagacaggaggggttcatgctctgagtacaggctctggggtcagagaagaatgggtccagatcccagctccatggctgtgcaatcttgaacaagttgcttaaccactctgggcctcactgtcctcacctgtaaaataaggtgttcctgaggcattaggaatgccctgggcgactgtgctgagaatgcaggagcagttacaaggctaagcaactgttcctctgaaggggtcccctgctcagcagagcctcaaaatttggtcctgtctctgcttagggctttctgacaaagcagagtggggaagggaaagggaggtttctggaaaagccagtggccaacttctgggtaccgcggacaggtggcaacacctgtccaaggaccaggcatctctcaggctgtttctaggctgctccacatgagggagaaatgatgggctttgctggccagcccaacaccgtcagagggcatgttactgctcgaaagtacaaaataagcagagtgcgcataactaaacactatttttatcgtctttccgccactctcatgccacaagcaagagctgctgtgtaagggagggtggcagggagatgtttattcagagcatggggtggcctgaataccaatggggccagttgagaggctgtgttgtaagggcttttaggggacagcacccaggagaatcgcagccaccctcaaggctgacctaggagacaaaattgccttcctccccaaactcagccctgcaccctgctgccctgggtgaggaccttatctttcccccacctaggaatctgcaagggtatctttcccttagcatcaggaacaaaacttaccctccagctctgggcaagaaggatctgaaaatgacagttctagggtcgtttggggcaggtacaagcacccttattcctggtgtccagacagtgcatggtgtaggtatacagcaggtactagatgacaattccataaaagaagtaacatccaagggcttgggaggcatctacgaagaatggcaacaaaacccttgccttcacagaactttattctagcacagggacacagaaagatgacagatataacaaatagtgcacagaatagggtagaagagagaagtcagtggttaggatgatgcaatgggtgcatttcttaataaggtggtcaaggcaggctttagactgaaaaggtgaggtataagcaaagactcccagtgggtaagtgagcatgctgcttggctaactgggaaaaagcatttcggggacagggaaactgctgtgcaaaggccctgaggtgacagcaagcctcacgttgctggtggagaccagcaaagaagccagggtggaggaagtaaaagatgaaaaacagaagcttaggtcaggaagaaatgggggatagatcaataaagcattatagagccaggtttttgttttgttttgttttgttttgttttgttttgtttttggagacagattcttgccctgtcacacaggctggagtgcagtggtacgatctcggctcactgcaacctccatctcccaggttcaagcaattctcccacctcagcttccagagtagccgggattacaggtgtgtgctgccatgcccagacaatttttgtatttttagtagagatggggtttcaccaggttggccgggctggtctcgaactcctgacctcaggtgatctgaccactttgacctcccaaagtcctgggattataggcgtgagccaccacacccgacccaagagctatagttcttaactgggtcaacttgacccacaggggacatcttgccatgtctggagacatttttgttgtcacacttggggaaggggaatgctaccagcaactagtgggtagagtccagagatgctgcttaatatcctgtaatgcacaggacgaccctccacaactaagaatgatctggccccacatgtcaacaagttcaaatctagaccactgtaaggcctctggcttttgctctgaatgagctgggattatttggtgaatgaatgaaccccctctgtgcttgcactgatgataacacagactgtaaatctggaggtgtttcatcttcctccaaaccatttctcgcattcatagagtaaggaagaaagaaaagacaccttttttttttttttctccctgcgccaaaagcacacagtggaactcctggttttgaaatgtcctattttatgtgggacctaaaaggatgccaactgtcttctggcctagtgacaacaaaagtgacttcttggaaagctgcggtaacatggaggtggctagggagcagtccaagggaacaaaacaaaacaaaacaaaacaaacctaaaccaaaccatgtttagcaaggcctggggggtgttggggtaccacaggaggcaggctcagcgcgtttatccccatgtaaagattgcagagatggggctggggcttcgcgggtgatttttttagtgctttcacctctaatctccaaatcctagccctgctccttccagaaacctacagccttgcctaaattttgtgtgggtgattaaagcagaggacccgattccctgttcctgcctctctgtttgtgaataatcaaaggctaatcagccaaggccccaggggacaggaaattagacgtgcaagataccagagaggctctgagaataaaactgcgaggtgaatctgacatcaatgccagcaggggtgtctgggctctgatgggcaggagcgcagagcccggggccaactggggacaaatccgatttctccagggctcagctgacctctggcttacaccaaagacagagaaggacaggctgcaagaatctggcttttctccatcagctcagggatcagtcaaatcaaagcattaagaatccagggtgaactctgatattagcgagggcaaaggggatgttctccagactgacacaaaccaccggggttcaaatccccgctcctccacttcctggctgtgttacagtctaaggtctttgagtctcaatttccttatctgtaaaatggaatcaaatacaaataatcaggaatgactttccgagtttcttttggtagaagagtggaaatgaatggagaggaggaagcagaagtactatttagtgactcttgtgagctagacattgtgctcaatgctttagatttatgtttatcgaattctcctaacaactcaatgcagtattggatattccattttcatatgaaaatgctgaggtctcaaaggataaagcacttgcttgagtcagggaaatgaatcccctttccatctgcctccaaatccatgttttattagtaacaccacccaacacagagcactttgaacttctcatgtgtactgccatgctgggtccttataatatatatcagcacgggtgcagtggctcacgcctataatcccagcactccaggaagccaaggcaggaggatcacttgaggccaggagttcgagaacagcctgggcaacaaagtgagacccgcccccaccgacggtgtctctaggaaaagtaaaaaacttagctgggtatcatggagaacgcctgtaatcccagcactctaggaagccaaggcaagatcacttgaggccagcggttcaagaccagcctggagaacaagtgaggaccccatctctaaagaaaatgaaaaaaaaaaaaaaacttagcttggtatgggggcccatgcctatagtcctcactactcaggaggctgaggtgggaggatcacttgagcctaggaggtcgaggctgcagtgagccatgatcatgccactgtgctccaacctaggccacagagtgagaccttgtctctataaaacaaaacaaaaggccgggcgcggtggctcacgcctgtaatcccaccactttgggaggtcgaggcgggcagatcatgaggtcaggagatcgagaccatcctggctaacacggtgaaaccccgcctctactaaaaatacaaaacattagccgggcgtggtggtgtgtgcctgtagtcccagctactcgggaggctgaggcaggagaatggcgtgaacccgggaggtggagcttgcagtgagccgagatcgcgccactgcactccagcctgggcgacgagcgagactccgtctcaaaaaaaaaaaaaaaattattcctgccgagggagccagtgttaagagctatcacggctccattctacagatgaggaaactggagcacatcctgtaaggtctcacttgccaaaatttttgtctccaagagaaaaccagaccctcccttacaaaacaagtcaaaatgagtgtaaaatcggttccgtcaggtgacagccatgaggagacggatggtgtcacatctagtgggggcgagggaatgggctggaggtatagtgtgtccagttgcaggaccaaaaaaccttggcccataactaacgttccctgcacagccaccccatgccacacgcagagcccaggagatctcatctcatcttcacagcacgcctggtggcgagtgccctcactgttcccattttacagatgaggaagatgaggctcaaggagctgacgtcatttataccacactgctattgagtggaggactgcagagttgaaccgggttgcttagcacctttcctgctgctctgaggtcccttaaagtctctgtgaagcgtaaggatgggaggtgggagtcctgaaaaactggtctacctgctgctgtgcgagattgagttgggacagtcagctctcccctctctggcctcagtcttcacccggcagggaaggggctccactgaaggtccttcagctctgacctcctgtgctgctcttcatagaccgtcagctgctgcttcctaatgcaaatgctgtcacttgcctcagggcctttgcacttgctgttctccaggccaggaaaaatatccgtctggatatcctcatggttcactcctcaagcaacttgtcagaggacacgccctatgagagccaccaccccctgccccataggcattccccattcctctaattatgttgctcctcaggccacgtatcactctctgggctattaaagattataattataatctacaatgtctattattaatatgtataatatatatttgcttattgtctgaatatattctatttatatataatattatgtatttgcctattgtctaaatcttccaactagaacgcaagctacttttttatgtcccttcagtatgcacaaaccctggcacatgacaggcattgggtaaatatttgtggaatgaatgcctggatgcattaaatccatttctgggcacctactgcacttaaggcagacgggaaatgcacgtggttaacccaccaccaccagagcatccagctccatgcctttatcaacctggccaccatgtttcatcagcaaatgtgaattgggggaaataacagaatgaagagggggtggcagtaagccccagcaggcttcaggaccagataaaggaggccaaaagattccatttgcacaaaataccatgcagccctctccatcccgttaacccgctcttcctcaaggaacttccagaacaaactattgccaaacaccattgagtttaattactcagatgatattaatagtgcagccagctttaattacagacgacgctgctgcacaggggctaaagacaccctctgaattgctagcgtcccttccacctcgcttctctagctgaggtcgccatatgtgggagttgatttagccttgactctgccatagagacttaccagcaagctttaggagaagagaggctttttgtcccctgcagaattgaatgggggccactcatgctagatttccctaactgccagaacatagctcttatataatgaaggcccaggaaggtctgcagaatgagactggttcgagttcttagagaaaagtttcagaaagacgagggacacaggaaggattctgcttttcccccatcctggtggacatgaaggacccaggataagctatgatgctgctttattaacgaccctttttcaaagcactgaccccggcagcaggaatggaatctggccgcctaggctttctgttaatgagatgagaactgaagttcaaaaataaactgtgggaagcctggtagggaaataccagatgacaagaggataatctggtgaccaaaggcataaaaggtggcgggggtggggagcccacagctaaatcaataaccaggtcgggaggaatttgggggtcaaaagagtggcttagctgttaagaacatggtgaaaactgaccttggatggctccgtaagaatcttagctttgtggagatatttttgtgcctctgacaaaatgctatcttttaagaagtgtgcacagacttcatttctaggcatgtaaccttcacatttaacttgcatttaagcaaaatgatatgcgtgtagggaggattgctatggcgagtttttaattgccaaagactagaaaccacttcagcctcagcagttgtggtatggttaaataaaccatgctatgtgaatgcaaatgcaaaataatgcagctatttctttctttcattctttcttttttttttttttttttttttgagatggagtcttgttctgttacccagtctggagtgcagcggcacgatctcggctcactgaaactgctgcctcctgggttcaagtgattctcctgccttagcctcccgagtggctggggttacaggcacctgccaccatacctggctaattttcatgtttttagtagtgacggggtttcatcaccaccttggccacgctggtctggaactcctgggctcagatgactgcccaccttagcctcccaaagtgctggagttacagatgtgaaccaccgcgcccagcctaatgcagctattaaaaagaatgggggccatgatatatatactgaaccagaacaatcgatgagctagataggtaagcgacaaaagcaagacacaaaataacacgtacagtttgctgctataagttagactgtgctttaagcaccgtctagagcaatccataagacaattcagatcctttctcattagctgtgcaactctgggtatgttactttacctctctgggcctccgttcctttctctctcaactagagctttaataggagttagtttgtatatctaaagcacatattctcaatagggatgactgtcacccccaccaagcaagcaaaatttgggggagtatatgtgtgtgagaaaaaaaaaatcttaggctgggcacagtggctcatacttataatcccagcacttcgggaggctgaggcgggtggattagttgaggttgggagtttgagaccagcctggccaacatggtgaaactctgtctctactacaaatataaaattagccaggcatggtggcgggcgcctataatcccagctactcaggaagctgaggcacgaaaatcccttgaactcaggaggcagtggttgcactgagccaagattgcaccactgtactccagcctgggcaacacaacacaactctgtctcaaaataataataatagtcttagatattgcaatggtcagccgtcccccaaagctcaaccctatctgataaaatcttttcccacagtatttaatttctctcacaagggagaatttatattaaattaaatttttcttcttgggagggtgataatgaaagaaagtaatgcttgagtaatactgagctaaagtactcagaacagcgtgaagcagatggggtgacatttaccttgcaatgtcgctgccaagtttaaatacaataatagatgcaaaggccacagtgcgaaggcgtttcatcagactccaccgcaacaacaggtggcgaatgctaatatcaactctcacttcttagatgaagactcggaggtttacaaaagtggaaagactaggccagaggtcagcatctgagctggaattttcacctggtctctctctcagactaagagcttcctctttatgctccagtggtgcttggagaccacatggtctgtttgttctggtagcttccctaaaatacatgtcagggctcggcacagtggctcatgcctgtaatctcagcactttgggaggccaaggtgggcggatcatttgaggtcagaagttcaagaccaatctggccaacatggtgaaaccccatctctactaaaaatgcaaaaattagccaggcgtggtggcatacaccctagctactcaggaggctaagatgggagaattgcttgaacccaccaggtggatgttgcagtgagccaagattgtgccactgcactccagcctgggtgacagagcaagactcgatctcaaaatactactactactactactactaataataataataataaaaaaatacatgtcgaggtcaacccaggcccaggtaccaggatgtgtccttactctgctgagtatcagcataagatgtcgagtctagaccaggggacaccgtcgtagcagacagccatgaatacctcatcctgtctgctgttagcaagctgcaaagcctgctggtccttcctcttcctcctcttgtgaggccctctggagaaatttccatctgaactgagcactgagaacagatccacctgccatgagcaatggcctgtgtcaattatttggatacagggcagtggaagggacagatttgttttccttgatggcagccagaaagctctttgtcaaatctccagttccccaccatggtgtaggtgttaatacctattccagctccaaggtatgatggtcctatggttgtgtttcctttctttgtctcagttttaatttttgcagtcttattttgtttagtacacccatgcagactgccataaacccttcctgaaagagggatgggtgtaaagagatgaatcaacaaaccacagaacttcaaaaggttccagaaaaaagccaccactggcacaataacgggttactcaatcccccaaggcttttgaggaagactagggaaggaaggggttgaccttgggtctagaatgggtgagggggagagaaaagagaaagcgagagagagctagcaagtgagcacacatgtgaccgtgagcttaatgcaaggggataagctggggtagggttggcagtatgggtagggaaggggagtacatgggaaaggaaaggggaggactggagcttcagtcgtgatggatcttgaaagacagaccactcactgattccttggtttactcattcattcattcaagaactaccatgtgcaaagaattgggctccctgcatgagatacaatgatgtaaaaaataatgacgtggttcctgccctcatggaaatcatatttagttcaggggttggcaaactacagctttaagaccaaatctggcctgcaatcctcttttgcgaaccaaagttttattggtacacaaccactcccgttcatttgcatattatctacagctactgtacagccacgctggcagaactgcttagcggtgacagagcccatgtggccagcaaaggctcagatatttactaatctatctggtcctctacagacagtttgcacacttctgctttagctgctattactgttgctgttgcatattatttgtgagcatataaaaatgtttccaataaacaaagagacatgttgatgcccccgtgagtccccagttttctctgccataaaactggcataagagggccattgtgagggttctaggaaaagctctaagaaataagcccagaacacagacacctacaatccttttacattttcattactaatgatattacaatggctgggagtaagaggaggaatcatttcacgccacatgtctgtctttaaaacacattcagccttttcactctgattctagaaacaggtatgattagttgatcaatgggacctcaatctagacaatccaggcatttgaccacattctcctgatttttcagatgaagattttttttcccatcattttgacatttctggaactgaggcttatcttataaacactgtgtacatatgatttattaatttgtatttgttaagagcaaatgatgtggcagacacacaagatacaggaacaaaatacatatgtgagcaatgcatgtgtgtatatacatgtgcgtgtgtgtgtgtgtgtgtacaggtgcatgcagatatatatgatagttcataagacatcaatttatgctaacgttggaaggtaagaaggcataatttatgcttatgttggaaggtaagaaggcagtaacaccttaaagtctgtcagttggtaataaccatcgtggtgaagggaaaaaaaagtagatcagaggaacagaggagagcagcagtttgcaattttcagagcaatggctgggatagcattcctcccaaaatgacctttgatcaaagaccagaggcaggtgaggagcagatgtgctggaattctggcttcaggcacaggtaagggcaggtgcaaagatgactatctctgtcagtgtgtctttttttccccctccttcctccccaaagctgttgccaacacaatactgtcctccagtcacagaaatgctgtatgtggatggtataagcatgctgcgaaaaaatgctgcagggatttggaccatttggaccgcgcaggggagggtgttaaagtgattgtaacatgttttatttcagctagttcttcaagctcagctcctttgaaatagctgacatgttttcttggccctcaacctgctgtaagcctacgtccaaaagcgtcatatgtcaacaacctggtaaatccacagttaagattttttttttcccacaaaaagtcatgggaaccaaacaggctctgaccaaagttgctggaccagttaaaccactaccagttacttctttgcccacggtgagtaaggctgcttgggaaggtaacctattttctctgaatactctcaaagcattcaagataaatatatctattcatttgtatatcccccaacttggcacagatgaggccttgggtttggatagtaaaatttaacactaccctatgacatttcaatgctaagtttcttggcaaactcaccaagattgcagctgtaggcccagaaagaaagggtgacagcttccagatggcacaggaatgatctggaagtccttgcatgtttatagcaccactcagtgccgcagggtgcccactgtgggccgggggtcatgtttaatttcactaactcctgatgatgagcctgcatcatctccctattgtacaaaggaggcgacagaggttcagcaaagtgctgactgcaaagccatcccagttccccaaatcaggatgcccccttgtcttgaccacccaggacaggatgggagtcattctccaacttagattccagttcatgtgtccaatgtgagcctaagactacagtaactaatctcactactttccctatctagtttccaaaacaaaatgtcctctggataagagcgaacagcagaatggagtttgtgtgtatgtgtgtgcagctttagttttcttaatatttacatataatacagaataccttcttcttcttcttttttttttttttttgagatggagtctcactctgtcacccaggctggagtgcagtggtgcgatctcggctcactgaaacctccgcctcctgggttcaagcgattcttctgcctcagcctcccgagtagctaggattacaggcatgcaccaccacgcccagctaacttttgtatttttagtagagacagggtttcaccatgttggccagggtggtctcgatctcctgacctcatgatccctccaccaccgcctcccaaagtgctgggattatagacgtgaataccttctttcttaacagcattaaacagacgaagtattgctcgactaagcatttgtaactataaggacccggcaaaccccagactctgacttccggagaactttatttccacatgaaaagagcccacacatgttagaaacagtcagtcctgtgttcagattccccttcccctgacaccgccgtggtggggagtccctgtgggggcagtcacttctttcttctaacctgagtctgactcatcctctcactcctctggctaaggacaggaagggacagtaccctctgagaacctgctgagaactgctgtgatgtcccttccctgacccaaacagaaggaggtacccctgaaaaggagacaggattaaaaagccaacccagagagcctctgggtgccaaaggactgccgaagctctttaccctccctctgtatgtggaaatttcagggtaacttaccaagtgctttcttctcttaggagccacagtctgtgtgtactcagattgggagaatgcaaatataagcggttgggagagggaaaaagaacaagagaataggagcgagaacattgggagagagagaacaagagacagataataaatgagaggagaaaaattcgagctacacaccattttcaccctatatactgactttgaagccttaaggtcagccaggcacagtggctcacgcctgtaatcccagcgctctgggaggccgaggcaggcggcgcgcatgtgtatactccaagctactctggaggctgaggcaggagaatggcttgaacccaggaggcaggggctgcagtgagctgagatcacaccactgcactccagcctgggtgacagagtgagactgtcacaaaagatatatatatatatatatattccctctaagtctaagtaagatacaattcctctatacgtgtgtgtttcactttatgcagcagacagacttccaaaaaactggatatgaataaatttcttaaaatctttttatatacatgaaaagtcacaactttaaggtaccccattcatgaggacatgaatcctttggtaagattaaacatccaaattcctagaaatatatccccttgggaattttgagtttcctagtcttgaatgtccttacattcatgaagtcaaaagggtattagaggcatctcttccagccccttcactatgcagaggaagaatctgaggcccagagaggcagggtgacttgcccaaggtcacacagctagagtgagtcagagctgaagcctgaacttgggagtgtagtctctgtagaggtgcacgtactggcggttactcacttgtgctacctgaaataaatggacctgagaatctggtagttatatgagcctgcagttttgtggggtttttgttgttgttgttgttgttgttgagacggagtctcactctactgcccaggctagagtgcaatgacattatctcaggtcactgtaacctccgcctcccgggttcaagcaattctcctgcctcagcctcctgagtagctgggattataggtgtagaccaccacgcccagtaatttttacattttagtagagatgaggtttcaccatgctggtcaggctggtctcgaactcctgacctcgtgatcggcccgcttcggcctcccaaaatgttgggattataggcatgagccaccatgcctggccgagtctgcagttttaatgccttattttctggaagtcaaaactgtattactgaggtgtttctctttttcattacaggagtcatctctattttatttatattttgcagtgaaatgatttaaatcaaatgtgcttgggtgcagaggaaatctgatctgaaagagagtttttatggcagagagagagccagcagatacttatttcctgccttgaagaggccagtaacatcctggtacaaggggattcatcaatacatctttcataagagggcttctctgcacagtgagctggaaaatctttccaatgactctggcccatttgtaactttgcccctgaataaaagaagggattgatcggggcttggaatgcttccatacccagggccttcctgcaccccaggaggcagagtctataaatggaattcaactgggcaattgctcatggagagaaaacccagcaggggtaagcacagcctctaaggagagggcagtgaagggttaaaggtgcaccaccttcctctgctggggtctgcagagggactgatgcctggaagtctctaaaataaagagtctcaaaaatagtcagagagacttgctattgggtattctatggactgcagatccattccccactctccatgatctgcagtgtatgctggtggtgggatataccctcagtgtgtccatcagtcagtcagttggcatttctcaagatctacaatgaaccaaagcagagtgagagagcttgaaggcttcgtaacatggcaaaggggcacggagaattgaaaagtatgtccagttcctgtagacacatcccacaaccccaacctcccaagatggtgccagtaagctttctgttgggtgagagaccaggagacctgagctccaccctggaccctgccacttaagttagcagctcttagggaactgatttctccctttgggcctcaaaagcatgtccaagttgactaagcctgctttaaaagttacttggagaagtgctgagatgattaaataaggacagagtccaacaccaggcacaggacaggccctgaatgaagagattacttcccttctccttagaacctttcctctcctcacccagctccctgtaaggtgaagatacagctctatctacaaagaacggtcacttctctcttcctttctctagggtggtttgggttcaaagacggaaactgtatttgcacccttgcaagctggttcggtccacacttgctttcctacccaaagaccaccacaatccctagcttctttagaacttccttggcatgtgaacttgaacaataccctactcttctccaagacccagtttcagggtaaatgggattagaaaacctaatttagtcagagttgctatgaagattagaaatcaataggtttcccagtacctgacacatggtagatgcccaataaatgaaatttattattttctgcaaggaaaataacatctatctcctctaattgtcatgaggattagaagtaaaatacaaagagcatttagcgcagtgtctggcgcaaaatagcggatactgtatacatcttggttgatggagacaaaagatcaaaagaggaacgtaaacgtgagcaaaagcaaaaaataaaaataaaaaaaaaaggttcaaggaaaaacaaacgtctagcccagagcctagcaatcagagagagctagaaagatatgcgcctaatgcaaagtaggagaggtggaaaggcggctcagagacacgcaagggtctacaacacagtttctcaaccttgacactgctgacattttgggctggatcattccgtcttgggtgagtgctgtcctatgcagtgtaggatgttgagcagcatccttggctctacccactagatgccagtagcatccgtcccccgtagttgtaacaactaaaaaaatgtctctggacattgccaaatgtcccttggggaggcctaattacccccagttgagagttgctagtctaaaatagtgtctgacacaccgtgggtcctcactcagcaaatacttgttgaaagaaggcagggatggaggggagagggatcaacgctgaccaccccatacctgggtagggcaagccctctggcttgcctgggctgcttcagccataatgaacgggtgggagggaggctcttcatggacatgcatcagcttggtttctctgaaacaggagggtgttcctagagtgtactgtctgtgctgtgccttgttaagaggggaaattttccaagaacctatttttccagcgctgcagatttcacgtggatatggccttaaacatccacaaccctgaacctgcatctcattcctctgccttcaaagggattctttggaagcacttcttgtcccaaatggtttaatgcctttattttgcgaatgagccattgcagtcaagaagattaacagggttaagatgtgtgcttgtggttctgggcttagtggtggaaaaatcatgcttcttgcttgtgaacttaaccttttggtggatggtgagaaaggctatgtggggagtgaaataaaatgcataggtcacgggggtaggggccccaggggccaggggtggcagggaagagatgccgtgtgtgctcaaaggcagctcaatttggaggctgggagtgggaacacatcatccctgtaaagatgggatcagattgaaacttctgggacctgatttcaggaatgagctgcaacaaaatgcccgcacacttcttgaacaccttccttttcctccccagctaaaatcctttcctgattcctcagtctcccttgggttcattcacttccctccagccctacttttcccctcttgcttctgggcagtatctttagccattaccaggttttcactcacaccaggacctttgcacatgccacttcctcttgctaaattaatcttcattccatttacacttcttcctttcagcttaaatgtcacttccccggggaaaggctcctgttccctttgggtcaagactcacagtcatacagtctccgtacactgggaatttaatcccatttcacttatcacagtcccactcagtgactggcatctgtccccaccagatagtgatgtggcctgagagcaggaattgcatcttctgctcaataatgtgccctcctcctactcagggtcagtaaacatctgtggaataagtaagtgcataaatggggaaaaggcaggcccggcgcagtggctcatgcctgtaatctcagcactttgggaggccagggcaggtggatcatgaggtcatgagttcaagaccagcctggctaacatggcgaaaccccatctctactaaaaatacaaaaattagccaggcgtggtggcacacacctgaaatcctagctactagggaggctgaggcaggagaatcacttgaacctaggaggcagaggttgcagtgagccgagatcgtgccactgcactctagcctggatgacagagcaagactccatctcaaaaataataataataaaggagagaaggaagagagagctttgttccgagtgtagacaaagagggtttctttcaggggtcatgtcccacagctccattcccagacaccattagaataaaacacagcatggtgtcagagcacggagaaaaaggtgaacttccttctgcctcctttccagctcacacgcatcttgtttccagccccaaacttgatgaagatggggctcccttccttgccttcagcccaggataatcacctgctgcaaatttacccggtgtttaaattgtaacagcaagtcaccaagctcttattgtcacagtagcagaaggggttacatcagagtagaagatgtggaccttggcctcaaggagcccagcagtatcagcactcaggagctggttagaaatgcagactcccaggccccacctcagatgggctgaattagaacctgcatcttaactaggtcctctggttcatgtgagcagcctcgtgggctgctcatgggcttcagtagcctgctcatcagaatcatctggaagatttgttaaactacagattgctagagccctgccttcacccccagtatgtgattccaagagtctgggggtggcaggtgaaggtgcgtttctttccatttcccatgtgatgcagctgctgttggttcaggaccacgcttcgagaacagctgccctactgctcagacccaggcacacagcttagtttccagccagatccatgggactgtgggtgaattccttccttcttcaacaacgttgatgctgatttcatgctgtttgtgcaacttaggcagtaaaaagtttcctttcccccttgtgtgtattagtctgttttcacactgctgataaaggcatgcccgagactgggtaatttattaagaaaaataagtttaatgaactcacagttccaagtggctggggaggccgcacaatcatggtggaaggcaaaaggcacgtcttacatggcagcaggcaaaaggaaaatgagagccaagcaaaaggggtttccccttataaaaccatcagatctcatgagacttattcactacaatgagaacaatataggggaaactgccccgatgattcagttatctcccactgggtccctccatggagggagggaattataggagctacaattcaagatgagatttgggtggggacacaaccaaaccatatcaatgggggtttaagcagaggtctgaggcccagaaaggccttctagaagagtcaaggtgtgagctggaggatgaaaaagagcttgccgacagacaagaggaagaggggcgttctagacacacagcactgcccaagccaaatgaagcaggcgtgaagccaggcacgcccagggggtgactcatctgctgtgcccagagctcaggccaggtaggagggagatccaggggaagggtagggcctggagatcacagaagttctgcctcctgttacctgtaagatccctgctggcatagtactgtgaaggactcaatgaaacatccctgaaatcctcatgatcatcagggctggcattcctgtagcgcttaccatgtatggggtcttgtctcagggccttacccgcattaacatgtttttctttctaacttaaaaaaataataattatagactcacaggaggttgccaagatagcagagttctgcactccctcacccagcttcccccaatggtgacatcttatgtaactgcagtgcaatattaaaaccaggcaattcacatcagtacaatactgttaacgggactgcagattttgtttttgttttcacccattttcaacatactcatgtgtgtatccgtgattctatttactgtttaatcttcacagcaatcctattatcccattttgcagatgggaaaactgaagcacagacagaataaagacagaataaagtgacttgtccaaggagctcgaattcagggaatctagctctaagctactatgcagtgttacttctccggcaagttctggtaactagtgcaaactcgctcatggatcagagatgtttctgagggtactcatatttgaaaaggacttctaggtgtcaaatgtaggttccagacccatcccaaagaaccggatcctcttggaaaagctccccctggccggggctgagcagggaagctgggagagagggcatgtccgcccagggccatggccacagatccccagccttgttggctcctggatagtctctatcccagctcaaaggtgtgcctgtctgcctcatctgctctcaggtttctggtctggtgatgttctcgggactggcctgggctgcctgccaacaccagaactagacaaaaatctgcagttctgagcctcagcccctgcccctggagccctggcaacttcacagaggcctgcttgtgaggccaggaagcaggaagctgggctgctcagccctccgccaacctccaggcccctggctgctggggctggaggagggagagagaaggggacagacaggacatccagtaaagctgtaacaccaccaaaaaaggcctcccacacaagccagccttggcagccagcgacctaccagacaaggcccccctttcctgctgacttttatggagtgttgggctccttggaagggaatgttccctgtgcttagaaatatgtggagatgatctatgcatgtggacagggactgcttagacccatgcacacagcttggtttctagccagatccgtgggactgtgggtgaattctttccttcaacagcattgatgctgctataatgctgtctgtgtaacttaggcaagaaaaggtttcctttcattagaggggaaaacatccaaaccattaaaaaaaaaaaaaagttcataggaatccatgatagcattgggagtggttctgcccagacatggagcgactgtggttaggacccaagaaacagcctcatctgttaacctctccaagactcagtatcctcagctgaaaagtgtggattaggctggaaggatccagcccaaactatgaacctacagggagaatgggaataaggggatataattaaggggcttttatttctattctgtccagagattcaaaatgcagttgcctcagacaggccaggcctcagccatgtgtcaaggtcatcagtgataaatcaatccaccctgggagggtcaggacactggagagggtctgtccagccaaaagaacattagaactcaattgttttaagacactctgcaggccaaaccaaacttgtcgactcactagttactagctttgaattctaaagtcgactcttgtccagaaatcatttcaggagctccaaaatctcaagatcaggagatcctagagaaagattagaagcaacaggccccttgtgtgtggcccttaagttaacacgtcactggctccccagcagggaacctggtgggccctgacttcaggagcctccccaggcccactcatcacccacaaaacagcacccttggggtgctgcagagagggaggaaaagtgcttagtcagcccaccccgctgcacgttgccgagtcagtcatttttttagagccctctagaaaccactagattccaggtcctagaatatgcactacaggcttcccttggagcatgagaagtacctctctgactcccaccaattgctcctccatgaatggcagccatccatccatctgctatccaagagaacgcatactgggtgaaaatgtatgcacaatcagctgagagcaacatgcgaaaccaaattattatctatcccctcccattccaggaaagaaaggcctgtgatgaaagacacagaaacaagaaaaccactacactagtgagagaaaaatcaataatcaaagtgatagaggagaaacttgacaaaccaaagctaacagaataattatgattaacattagatgaggctctgagctccctggtggccaaagcaaaaagggatgctttgtattatataactcatatacaacttgacagctagaagcttagccaaagaaaaagagaaaagttcagtcctggtacgagtttgtcaggcaggtgtgtaggtggcggaggtgataaagtagagaggtgagaggtacccaggtcaaatgcagcctggtgggccaaggtcaggccttggcttatactgaaagaggcatgaggagccacgtggcgggttattcgcagagtcaagacttcatctgactcatgatttaaaagagcagctctgggagctatgctggggatggcccacctggggaaaaggcagaaggagggaggaagatttagagactacagaaaaaagccaggcaagtccttaggagaaaatccattctccttcctaggactgacttacaaagctcagcatgtcctgaacctgcctctccattcaacccaaactcatttctctttccctccctccagctaccctggtctccatctatctcctgccttgtggatgctctttgtcaccttgtgcatttgcacatgttcttccccctactggcatgttcttctccccagcctcatcctttgcatctcagctgaaatgtcagtttcctggagagccatttcccaaacccctatcacaagtagagaattctcgctcccctaactctcaattctagaatcttctgcttctatctcagcactagtcacagcagatcgttattgtaacactgtacctatgtgttggttgttggttttgtcccgtctctctaccaggatgtctattattctaggaagtcaaagataagtctattcccattgcatttcctccagccccatagcataagacttggcacaaagtaggtgcttaataaattatggcgaacaaatggaccccatgaggcagacacagaattagcttcaggttagaaaacggaagctcagagaggctcaggcaacttgcccaaggtcacctggtggtagatctcaagtctgactccaaggctaggccctttgaccctatacccagtttctctgaactcaaattagatgaccttgccctgatcatgcctcggcaagtccctggtaggaggtccttaccactgcattaaaccaagatcttagcgctttgacaaagggccaacgagaacatgaagatgatctgtaaagtccctagaagacgccaggagaagcttaggaaattgcagccgcacctgggtcagatcccaacagagtacaacagcaaaggggcactaggaaatagcccccacctggttggccacactgcctccacctttcaccactcacaacacaaactattctccccgaagcgcacagcttttatctgatcaattttctaggctgtggaaccaaacagtggaatccacaggaaattaagcttattgactcagtctttgaacaccacatggagaagagatatttacacatgtcatcggagccctggggactgtaggttattggcagcatgtatttacagagtttcgcccaacagtggagatggggagaaaaaccaccatgcctccccctccatgcagatttggggaattcagagagatgaaacaagagttaggaccccctgctttttatttatttatttatttatttttgagacagtctctctctgtcgccccggctggagtgctgtggtgtgatctctgctcactgcagcctctacctcctgggctcaagtgattctcccacctcagcctcccaagtagttgggactacaggcacgtgccaccatgcctggatgattttgttaacttttgtagagacaaggtttcactatgttgtccaggttggtcttgaactcctggcctcaagtgatcctcctgcctcagcctcccaaagtgctgggattacaggcgtgagccacagcacccagccaggatccctgctcttgaggctctgttttacttctgcttggctggctcagacagcaggatttggtggtaaagctaattttacacagaccctgttacctgaaagagctcactttgaaaccacaggcagattttttttttttttttgagacggagtctcgctctgtcgcccaggctggagtgcagtggcgcaatctcggctcactgcaggctccgtcacctggggttcacgccattatcctgcctcagcctcccgagtagctgggactacaggcgcccgccacctcgcccggctaattttttgtatttttagtagagacggagtttcaccgtgttagccaggatggtctcgatctcctgacctcgtgatccgcccgcctcggcctcccaaagtgctgggattacaggcgtgagccaccgtgcccggcccccaggcagattttatggagctctcaatgttgcagcaataaactgtgatctgtttccccatctaggtgtttgcctcctgccatttcttcatggttccttgactgtaacttctctttgggtcatttacaattagagaggtgaggcaacctttgacattcttgacggatgccctggaagactggtaaatgaatgcccaaattaaaattaaccacaataaataatggcatcagatgaggcacagtggctcatgcctgtcatctcagcactttgggaggcctaggcgggagggtggtttgagcccaggagttcaagaccagcctgggtaacagagtagtaactcatcactacacaaaatacaaaacttagctgggtatggtagcatgtgtctgtcccaggtacctgggaggctgaggtgggaggatggcttgagcccaggagatcgagtttgcggtgagccataattgcaccactgcactccagcctgggccacggtgggagacgctgtctcaaaaaaaaaaaaaaaaaaaaaaaaaaaaaggcatcaggagctagtatttatggtatgcagtatctctttaccctcacatgttaaatcatgtttccttttgtaatcagaataaaatccaagctccttatcatagcctatgatgtcctacaggatctagctactgcccacctctgtaatgtcccctctcttcctctcactcatcaatatgtttcagccaccacggcgagctcattcctgcctcagggcatttgcacacactattcctctgcctggaatgcttttccctgcatccttgaatatctgtctagtttattcccattgctcaatgctgggatcagttaattacctaccccacaccagtcattacccgtcttgtcaccctgtttaaccattatcacagcaccttttcacttgtttgaagcgttcttatgtatttccttatgtgtttatcatctgtgtcttcttgctaaggtcggtgaagctgagaccttggattttcagatttccagattcccagtatatctaatgcctgacgtgataccaacacatagcggatgctgaataaatactcaaggaagaaatgaaagagagaatgggaactggaccctgggtttacttgatctcactccaaagccggggctcttaaccactgagctacacagcctcatcacaggacactctgctgaatcagcagctcctgttcaaacagctagacttccaaagtcaacaccagcacatggcttttcgggggaggagtacatttcatcacaaggccaagattgtgttttgttttgtaaatcacttcctaagtattaccaaggctcccacaccaatgaatccttcctcctttcctcctgcagggtagaaggtcctggcttggttctccaaccagctaaaggcctgtttcccgcatgcaaagatgatgtttgtgctttagcaaaatgcaacgtcatgcaatcctggggtcagttatgcagatccgaagcactactggaattcagaacctggttccatgaatttgttaactgagtctacagatgtatataatgaacttccagacactcaagacgatgcagagaaaaaccagaaaactatagtgggaaaagcaaggattatgatgacaagaactccatgtggttccatcctgggatctgcttactctttttttttttttttcttcagatgagtctaactctcgcccaggctgaagggcagtggcacgatctcagctccctgcaacctctgcttcctgggttcaagcgattctcctgcctcatcctctcgagtagctgggattacaggcatgtgccaccatgccggggtaatttttgtatttttagtagagacagggtttcaccatgttggcctggctggtctcaaactcctaacctcaggtgatctgcccgcctacgccttccaaagtgctgggattacaagcatgagccaccatgcctggcctctccttattctcttgctgggtgaacttgaatgagctacctccactttttaagcctcagttttcaagtacgtaaaatggaggcaatgactgtgcatttattgggaagggcttactttcaaggccacagaaagaaatacatgaaaaaaaatctatcagaatgcctggaacttataataaatgatcttgaaacatttgttcaatgcctaccatgttcaaggtgcagcacagtaccttgcctgagagattctaagagcatgacaggaagggtcctgtctttattctatttcccaaattccgcatcagaacacataggctgatcaaagaatgggtcagagagtgtgaaacagagaccattcaggaattttttttttttttggaaactaaatctgtgtcacccaggctggagtgcagtggcgcaatcgtggctcactgcaacctctgcctcccggattcaagcgattctcatgactcagcctcccaaataggtaggattacaggcaagcaccaccacgcccagctagtttttgtatttttagtacagtcagtttcaccatattggccaggctggtcttgaactcctggcctcaagtgatcctcccatgtcggcctcccaaagtgctgggattacaggcgtgagcccccacaccccgcccaggaacatctcatatcaagataccaagcctgaatttgaattccagctctgacatttgaggcacccctcaccccatttctgggccttagtttccccactgaatggaaataatggcctatgtcatctggccccttcgtacctctccaccttctcccatccccttttctcagctcccctccccactggaattcctggagtcttcaaccatgctaagcgccaggcagttcgcatgctcttttctttctgcccagaacagcctttcttctggctcttctgggactagctcctcattcaaccctcagtcttccctggccatcctacataacatagcccactccatttgatctgacagcagctccttcttcacttctttattaccactaatcaacatttgtagtgatatatgtattgtttgtttcctgtctctttcttccccagactacggaggttgtaaacattcagaaaaaggaaccgtgcctgttttgattagcagtgtatttccaaaaacctagcacagtgcctgaagcacagcaggtgctcaataaaggcttgatgaggggatgggtgaaagtttggcattccctccaatctatcgcatcaaggccttcatctaacccactatgaagaccctcaaacacaccattcccaatgcttacatccaaaacctctttctgccccacctcctgaggaaatggggcatgagttgtgagtttccttagctgtgtgaccttggaaaagtttcttttttttttttttttgagactgagtcttgctctgtcaccaggctgcagtgcagtggtgcgatatcggctcactgcaacctccgcctcctgggttcaagcgattctcctgcctcagcctcccaagtagctaggactacaggcccccaccaccacacccagctaatttttttgtatttttagtatagacgcggtttcaccatgttggccaggatggtcttgaactcctgacctcgtgatctgcccaccttgccctcccaaagtgctgggattacaggtatgagccaccgcatctggccgaccttggaaaagtttcttaaccactctgtgcctaggttttcttaccacggaaatgaggttaatgataatagttcctgactcatagaattgtttttggcactgcatgagttaacatacataaaggacttcggtaaaatatacgtaaggcacttagcactttttatgccttgtatgtgaataaatgtcatctagggtaggtggagccctgtccctaccattccatgcaggtttccctgagtacctttttttcacacaggtaggttagctcctcatctacaaagtgctcctcaactctgaggcccattggaatcacctagagagctacgaattaccctggagttgtatccatacccacaacatcagactccagtggggcaggctgtacatctgctttttactctccccgggtgattccaacatgaatctgaaattgaaaaccactataaacgcctcatgctcaaaggatctcacaactgcccactgcacactgccctccccaacaaactttactatttttactgtaatagcccacattggacagttcccaaagtactaactagcctttttttttttttttttttttttttttttttttttgaggcagtctcactttgtcatccaggctggagtgcagtggcatgacctcagttcactgcagccttgacttctttggttcaagcaattctcctgcctcagcctctcaagtagctgggattacaggaatgcaccaccacgctctgctactttttgtatttttagtagagatggggtttcaccatgttgggcaggctggtctcgaactcctgacctcaagtgatctccccgtgtcagactcccgaagtgctgggattacaggcatgagccaccacacccagctatctgttctgttctccttagagcagtggttctcaatcgggggcaattttgccctgtaggggacatatggcaatgtccatagacattgtggttccagggatggggtgctattggaatctactcggtagagaccagagatgcttctaaacatcctacagtacctgggaacccctgcacacaaaaaatgacttatccagccccaaatggtatggtggcaaggttggcaaaccctgctgcggagctatcttttctgtgaacttggggaggacagcgcagccttgctaacaatgggaaggaaagaagaagtagtgaagggaacttatcatcactgagtttcaacaccaaacacataccaagcagatgtttcacgaataatgacaatagccactactttctgagcaccaaacaatggcttacaacagaacggaacccctgagttatcttacttaactcacatggcaactctgagttctttgactgtgttttcgcttcatgcataagacagcggggacagcaaggttaggtaactaggccaaagtcacaagacttgtacatgacagatttagattttagcctattctgttaaacttcaaagagaaggctaccccaacagattaatgatgccagctcacacctcctaagcctcacagtacctaccaggcagtgctctgaagacccgacaagtagaaacttaattcattcccatgaactagataatataatcatcatcgtcatcatcatcatctccattttacatcctgggacgctgagacagagtgctgcagtgtcctttgaagaatttcatgcagctgagatagggttttaacaaggggtttagatccagaatctggctcactcccaccatactctcctgcctctaatagagcaatgagcagaaaggatcgaattccagcctgcctcaggacctctgcacatgctgctcctgatgatgtatatgtcttcactctggcctctttgccctgctaactcttttttactcattggatctcagtttatacttccattgtctaggacaccctcctagccctgccaactcactgaccagatgagttatctccgttaaactctctcctagctccccttcatagcatttcacactttaaaagaacccaacacttgtgcaagtgtttggtgaccatcagtctcctcctatagactatagactccatgcagacaggaactgtctctgccttgtgcagtgctgtatctccaggcccctggcatgatgtttggcacaaagggggtgcttgatgaaagcttgtggctgaatgcatgaaacagagaacctaaaggcaaaacagcagctggtgccaatccggtccatttcctcatccccagagagggacagggccatctggcaggtcctagccaaatacctccatggcaggtcagggctgcagagctctccaggcaagctggccatggaggccataaaccaactcctcaaagccatctctgcttcatggtggctggtctttatcattttccaatcaacactggttgagttctaattgattttctatgatatccctctccagaagggagaaaggctctgtttactggggcagtacgtagaggacaggcctattcttcctgctgtatttaatgctgctgctaatcacggagattagactaaaacaattacaacagctaattaaagaacaatgcggtttttggcatcttcgcgcagacggcaccattgggaattcctaactcgggcaaagcagggataattaaaaccccggctccactctccccactccagcagctggatcacgctgattaaactgcaaataaaacacatgaaaccaacactttgtagtctatccaatttcacttaaaagggcttttaactgattcataaacagagaagcggtaaacagcaaattatttaactaaagccagttatttcgtcatcacggttcactttattcccagctccggacttgtacatgtagcccaggggacattaggttgatggggcctgaggaatcactccagagcttactgccacttgctcctgttcactggcaacaggacatcaccagtgtgtagctgctttctctgggttttttctccttttgaaaaaaaaagatcaggtagtgcccaagtccccagatgaatatgcccaggtctgatcagactctgctctcgattctaggtcaagagcagatggcagagacacagaaagttccgaagcgcagataatactaaaagcatcatatgtagctttaaaacatttaacttattcagagctggccaacttcagatctaaaatgcaacccgtatctactaaagtatgaaacagacttgttctcaagctatgggaagacatgtcacaacagctgggtagaaagctcatttgttttagacaggcacactctgagaccccagctcaggtcccatgcacacatgcttcccaactcatcttaacaagcatggtcatggggattgctaattctctctccaccttgccaatccagagacaacaagggaaaaaagtgagaaataaaaagaaaaaggtcaagggaaaaagaaaaggacagaagagaaaagggagaaaatggtaacgctagagacaggctcactgggagcagcaagaagggacagaaaaagaaaaaaataccacaagaaagcagacacagggattttcagagcccagcatgacacatgcggtgaggacctaggagccagcgcctgtccctttgcagtggccaggtatgatggtcacgttccacagcagtgcttctcaaaccagctgtggagaaaggcctttgtatgcccagtctactgcagggtgctaattttgtaaaataaaacaaaaaaagaagcattaaaaataaaagattgacttgcttaggtgccatgccatgtccggttactataaaagctgctgaaagcttgtccttcgtttctgagcgcgtcttcgtgcacacagtgagaaaccctggggatggcactggtccatggaccgacaacgctctgagtagtcctttttgaaaagatcccccacggtcattgggaataaacataatcagattcataggattctatttaatgtgcaccacatgtttttagtgaacaaatgcaggctttcagacacacataaatgtagaaaacaaagaccggaaagacatgcatcaaagattttatttcggaataatgatttcaccgatctttcttctctttttttcaagctttgttataaaatactcatgaaagttatttttaaatgaatattccatttatgaaggcaaagaaagacgatgctttatcataacacgagttatagctatttatatataattatggatgttatttatttataagtatctattatgtggttcaaaaaacgctatgtaactgcatgtagcctcatggaaaaaaaaatatgcagccaatatatatgatgtttgaaaagaatactctgggcgggggtgccgggcacggtggctcatgcctgtaatcccagcactttgggaggctgaggtgggcagattgcctgaggtcaggagttcgagaccagtctggccaacatggtgaaaccctgtctctactaaaaatacaaaaaaattagctgggcataggtggcgtgcgcctgtaatcccagctacttgggaggctaagacaggggaattgcttgaaccagggtggtggaggttgcagtgagccaagatggtgccactgcactctagcctgggcgacagagcgagactctgtctcaaaacaaaaagaatactctgattttagaagatgcttttgcaatttgatcatcaaattgccaatattgacccttttctgaccaatgaaaacagcaatttcatataatttaatctaatattaaatgggatctaaaaggttcccataaatagaggttgaaatcaattatgtagaaaatacacatacacggaaaagaagactggaaaaaaacatacaaaaagctggcatggcgattttattttttccttcttggtcattttccaaatttccaaccgtgggaatatattgccttatgagtgggggaaaaaattccattcaaacatttaattcagagaaattgctagcatttttgagagtcttaccctaatctggctacttactctgtgtctatgtgtactgggagaaagaggataatgagaaatttaaattcataagtattaactgttagatgattattaaattagctcatcatttctaagcatgaactgggcaggaagcatcatgtctatgcaggggaaagcccctatgttcaggagggacctgagatccgtgttccgcttgtctgaatctgccatccattatcctgattgttttcaaacagctttactgaggtataactgacatacaaaaaaaagtgcatgtacttaatgtatgcattttgaagagtctggatacatgcacagactcgtgacaccatcaccacaatcaaggtaacagacatatccgtcacctctaaaagtctcgtgtcccccttttttggtggcaagaacattaacatgagatctactctcaatacatttttaagtatacaatgcagtattgttaactacaggtgctatgctgtccagcagatctccacaacttactcgtcttgcagaactgaaactttataccaattggaaaatgcctccccattttcctctcccccatcccgtggtaaccattcttttatccatcctcctgtgatcttgggcaagtaactccctctttttggcttcagttctcctacctttaaaataaagaattttgaaaggttgacctctaagctccttttgcctttggtattccatgctcttagtccatgatggctggaatagaccccctaagtcatgagacccaaggcaaaataaaaacacaggacctcggcctggcacggtggctcacgcctgtaatcccagcactttcggaggccgaggcgggcggatcacaaggtcaggagatcgagaccatcctggctgaaacggtgaaaccccttatctattaaaaaatacaaaaaaattagccgggcgtggtggcaggcacctgtagtcccagctacttgggagactgaggcaggagaatggcgtgaaccggggaggcggagcttgcagtgagccgagatcgcgccactgcactccagcctgggtgacagagtgagactccatctcaaaaacaaaaaaaaacaaaaaaaacaaaaacacaacaaaaaaaacacacaggacctcttatgcaaaattaattaagaatcttaggatgctgacaacagaaattcaaacaagtgcagagccatggagctgtgtgtgactgcacaggccgcatgtccatgaagccgaccctgctgatggcagaaggccaaggacaaacaccaccaaccaaaataaaaaattctcagttatacaatagacaagttctgaggagctaatggacagcacgggtggggaatgatgtgttcattcatttgtgtaatgtcatcatcacacaatgtatgtgtatatcaaatcatcacaccttgaacacattgaatacattcaacctttatattccaactaaacgttttaaattattttttaaaaagtgtttgagaggccaagcatgtatatttaagaattattcacaaagtagataaaacacctgtcaacaaaaacagccatactcgggttgaatgattaaaaacgagcaacaacttccttttcttttcttttttctttttttttttttttttttgagatagagtctcgctctgtttcccaggctggagtgcagtggcgccatcttggctcactgcaagctccgccccccgggttcacgccattctcttgcctcagcctctggagtagctgggactacaggcacccaccaccatgcccggctaattttttgtatttttagtagagacggagtttcaccgtgttagccaggatggtctcaatctcctgacctcgtgatcccgccccccccccccccccccccccgcctcggcctcccaaagtgctgggattacaggtgtgagccaccacgcctggccaacaactgccttttcataattgatcacaatcagcttctattttataactacgtcttggaataggccattatgcttggatttcacaggcaagtctgcattttcctcgtcttaaattccatcgcggtgagccaaactcagtcaaccttttctgtgctaacatctgtgatcaagattaaagtaactaacagccagctctggctcttgaagcataactggaggataagatcaggtatttgcaaagtgtgaggctccagccacactcctctgcttcaaggacttgatgttgccttgactatcgttactctgaacactgggaggagaggaccatcatggagggagaaattgagtccacctccctcctttgaattaattgcaggagtaaacaaccacagaccacgtaacctccctttcacagagctcggctgtacagaacagcctagaatagtagggagagacaggtgccccgggtttaccaccagagcctatttttctctgtattcatttctaatgaatgagattatttctagggttgagaagcagggccagctgattgtcacaatcaggcatattaaaagccatgataggccgggtgcagtggctcaaacctgtaatgccagcactttgggaggctgatgtgggcagatcacctgaggtcagcagtttgagaccagcctaagcaacatggcaaaaccccgtctctactaaaaatacaaaaaaattagccaggcatggtggcgcacatctgcaatcccagatactcgggaggctgaggcagaagaatcgcttgagcccaggaggtggaggttgcagtgagctgagattgtgccactgcactccagcttgggtgactgagcaagactccttctcaaaaaaaaaaaaaaaaaaaaaaaaaaaagaaggtgtgataaataacactaggcaagaaatgcaagagcagaaaaaaaattatcaaaaaagaggcagatttttattttttaaagggactccagggtcactgagtgaagagctacagcatttttgatgcccgtgcgcaaccatcagtgcttttagcagaatctaaaacctagtgcttgaaatgatggctggattcttcaaggaaggcttcacacacattcagcgtactctatttgagaaggcaggaaaataaatgggtgatagagtttagaaaaattccttaaaagtaaagcttaactctccagaaatgaggctcccaaagcctccaaaacgctccagatggctgaagttttgctggaggtatgcgtgtgtgcatgttcacattttgtagcatttctatgtactgcttttaaaaatccatccttatcacaggccttcttagaacagtggtttgcaaactttttcagtaaagggtcagacagttaagattttcagtttagcaggccacgtgatctctctcacaacggctcagctctgccgctgtagctcaaaacagacatagacgagtacgtaacaaatgggcgaggctgtgttccaataaaactccacttacaaaaacagatggctggcagcatttagcccatgagccgtagtttatcaagccctgctctgccacaaggaacatgggctctggacagggcaggatctggattcaaattatttcaatccaccactctgtaaccgtgagactcagtttccctcttttaccatggggggatataatacattgctgcgtaactgtaaacatcaattggaaaacatagtagatatttgatacatgttaacgtccttatgccaatagtaaatcttttcatcttgctggttttcttagttctttatctatacgggtcttcatccacatggttcttttcagtcaaaaatggcctttctccaacattatctcattgccccacccttttcccctctcatattccacaaggctggtagacagacatcactaactgctctactgataaggaaataaacactcatggaagtagtactccagccagggtagggaattacgtgctccaaaccagcaacctgtgcctccgggtctgttacttgcacaaacatggacacccgtgagtttgtagacatgcccacttggaaatctacacatggacacagaagaggcagttaaccatcacagggaggggcaccaggcttggatcccaccttggtgacatacagattgtgtatccccaggcaaggtacctgaccacacagtctgggtttcctcatttatgaaatgaggctaaaaatagcataggttccagaagtttctacctcaaaatgttgagcgtctaacacctagcccatagtacatgttccatcaatagctgttgaatgaaccaatgtgatggtgagggttaaatgagaacagtattcatagccccaggatgctcaataaatggtcacagctctgcttagtgacaaatctatatgcaccacatatggaggtagatacacacacacacacacacacacacacacacacagctgtcagctccacatgggcaggagccatatctgacacaaagcacttgctcattacaaaactgtgtgttcatttatgaatatacaacacactcgtgcgtataaacaaataagtgcaaacagctgataaactgggttgggctccccaaggtccttgcaattctctctctacatccactcaacccccagaaggagcagaacaggttgatccagacctcagatgatgaaattctgctggctgtttactggattccagaccaccaccacccatacatatcaaagacccgcatcgtttcactccctgggctgtgactccagggtcccataaggtgacccaggctagaggtgccatagaaaatgtccctgctgggccaggcatggtggctcacacctgtaatcctagcactttgggaggccgaggcaggcagatctcctaaggtcaggagttcgagaccagcctggccaacagggcaaaaccccgtctctactaaaaataaaaaaaaaaaaaattagctggatatggtgatacatgcctgtaattccagctactcgggaggctgaggcaggagaatcgcttgaacccgggaggcggaggtagtaatgagccaagatcgcgccattgcactccagcatgggggacaaagcaagactccctctcggaaaaaaaaaaaagaaaagaaaagaaaatgtccctacttaagatgtagaggagcaaggggcagtgatatcctcaatgcgcatatcaggtggcgtttgagcacctgaggagtttcagggactgctgcccttgaattgctgagatgaggttctacctttgaacaaagatggtccgtgcatttggaaggaaagagctgacagatgttccaccgccctgcacaaagggagggcttatgctcaaccaggtcctggccattcccatgggcagagcaggcagccactgggcactgccagcttttcccaatatctcctccgagtccccacagccccttggctctgtgcacaggcgaggccgcctctaaagccaagaaggcaatgacccaactctggaggagggggagatgactcaagctacagcacacaaggccttctcagggccgccttgaccatgccggcctcaatcccaggcagttgccttcaccacaccaaggtagagtactcggcacttggacagtggcgtcagaacaagggtggaggccatgtcctctcggcatgacatcaactaacagcctggctccttggccctgaaagagaatgagccaatgtctgcctctggccatgcaaaaccaatcctcatttagtctgtggaaacagtacatggaaggccagatgtagcctttggcttgaagaactgagtttgctcaacagacacacgttttccattcaacactctttctgatttggttgcggttgtactgctgttgtttaaaggagggagggattaaaccaccctttttgagaggataaatgtgtggtgggtctgtatatgttgatgacagacagatacacacacacatatggtagatgttaacgagcccattttattgatgggcacactgaggattgaccaggtgaatgacttatctcagattgagtccacagccaggactcaaaccaagatataattccactgtccacttttccccaccacactgtggtataaggcctaaaattaatattatgtgctgccttgacacctggggaaagccaagagcatctcatatggcttgaatgtaagtttccctaactactttgcttcctcaaataaggtcctctagccagacagcctcctttgtctcagcaagaccaggtacagtgcctgcctatccctggagagtgggtttctgttccctgccagcctctgggattatttaaacaagacaatcatatccccttgtgggacacagggattattgcatcttcttgcttctgcatagcctgcctcccatggcccctggatgttcaccctgtccccagatacaaccgtgtggccctgcatggtgcacagcacctgcttccctggggctgactgtacgtgacacataaactgctgtccatctggtctgtccagctttgggtgttatccccatagggtgggaatctacttcaaccatggggtgaagtggaggcgatcaaaacacacaccaggctgggtgtagtggctcatgcctataatcccagcactttggaaggctgaagcgggcagatcacttgaggtcaggagtttgagaccagcctggccagcatggggaaaccctgactctactaaaaatacaaaaattagccgggcgtggtggtgtgctcctgtaatcccagctactcgggaggctgaggcagaagaatcacttggacccgggaagcggaggttgcagtgagccaagatcgtgccactgcgctccagcctgggtgacagagccagagtccatcacacacatacacacacacacacacacacacacacacacacacacacacacacggcttcctgagcaaagtgggactattacaatttccacagaatgatattccaaagtccctctctagaggtcagcttgcaacacacctccccacaggtggacactggtcagttttggaagagacaggagccaaggactctggccttcagataactaaacctcaagttcattcctagactggccatttatagtcatccagtagatactccatcattccattgtcactcttccacctgtctgtccgcaggagctccgaattctgcaacctccgcctttccgtgtgtagctcaagcagaatccagagagggcatgagcagtgggtaacaagggcagagtgtttgcaaacccaggaagaggtgacggcacaggcaattagaggcagaaccctgattaactgagcccaactaaccagaaccatcaattaactcaaatcttttttttttcttccctctcaggagactgaggccaggaattgagaaaatcacaatttaaaatggaaaaaaaactgtgttccgggcttttctctggctcaactctgacccaggtccatttccttcatcctcattcaagacacatgtacaacttcaaattttctagtagctgtgttttttaaaaaagtaaaaagaaattgattaatctatttgatttaaccaaatacatcctaaatattgtcatttcatcatgtgatccatatggaaaaagtatcaaatctaaacaaatatgaaaaagcattaaggagatgttttatattcttttgtttgagctaagtttttcctagagcacagctcagttggaactggctgcatttcaagtgctcagtaaccctgtgtggctggtggctaccatatgggacagcacagatctggagctaaagtgtgaagtgattgtttagaatgatgattctggagggttgctagggtttcaacgtccatgtcacctccaaaattcatgttgaaattaattaattaattaatttaatttattttttttttttttgagatgaagtctcactctgccgcccaggctggagtgcagtggagccatctgggctcactgcaacctctgcctcccgagttcaagcaattctcctgccccggcctcccaagtaactgggattacaggcatgtaccaccatgcctggcccatttttgtatttttagtagagatggggtttcaccatgttggccagactggtctcgaactcctgacttcaagtgatctgcccacctcggcctcccaaagtgctgggattaaaactgtgagccacacgcccggcctcatgttgaaatttaatccccaagggaagagtattaagtggtgggtcctttaggaggtgatcaggccagaagagttccgctatcatgcatggggttagtcccttacaaaaggtatggagagaactaagtaaaccccttttgcccttccatccctttcaccatgtgaggtcacagagttcatcccctacaaataatacagtgacaaggcaccatctcggaagcagagagcaaccctcaccagaccccaaacctgctggcaccttgatcttggacttcccagctttcagaactgtgagcaatacatttctgttgcctgtaacttactcagcagcataaacaacttaggccggggctttaaaacaaattggtcactagtgagtaactgcgtgctaagtgtttcctcccaacagtgcctcatgattgacaaactggtcttgggcttacacgggtctatgacgtcctggagtacagactgccaagtcccttctctacagccagggcctttcttcacaggaaagtgactgcagtaagagccacctgccatgacctccaccccattaattacctctttgtctgatttgcaatatgcaagccttctccataccttccacctaaatgatgaattcacacttcagaccaaaaaaaaaaaggaaattatttgaaaaggccatttttctactaaccacccaggaatgtgtaggtgtagcatttaatagtgcctacaaagtccctccccgaggggaccttgcagtctagcaaggacagtgagaagtacacatttaaaaaaagatctactattatcctggctaacatggtgaaatcccgtctctactaaaaatacaaaaaattagccaggcgtggtggcaggtgcctgtagtcccagctactcgggaggctgaggcaggagaatggcgtgaacctaggaggcggagcttgcagtgagctgagatcgcaccactgcattccagcctgggcgacagagcgagactccatctcaaaaaacaaaaacaaaaaaaagatcaactatttatgggtccaataaaaactagctactgggccaggcgtggtggttcacacctataatcccagcactctaggaggctgaggtgggtggattgcttgaagccaggagttcgaaatgagcctggccaacatggcataaccccatgtctactcaaaaatacaaaaatcagccgggcatggtggcgggtgcctctaatcccagctactcaggaggctgaggcacaagactcaactgaacgcggggacgttgcagtgagctgagattgcgccactgcacccagcctgggcgacagagtgagactctgtctcaaaaaaacaaaaaaacaataacaaacaaaaaaaaaactacctactggccacctggaacaagggttaaccaacatatgaggcagccccttttattggtgagaaaaccgagatcagaaaaatgaatgaattactatccacatgctcccacaggaactgcagaagagcgcagcccagaacacaggaagccttcccattttaaaatcattcatcgagtgtaatcccagcacttcgggaggccaaggcaggcagatcacctgaggtcaggagttcaggaccaccctgaccaacatggagaaaccatatctctactaaaaatacaaaattagcggggcatggtggcgggcgcctgtaatcaatcacagctactcaggagggtgaggcaggagaatcgctttaacccggaaggcagaagttgcagtgagccgagatagcgtcattgcactctagcctgggcaacgagagcaaaactccatctcaaaaaaaaaaaaaaaaatcattcattgagtaacttttccattttttgccctatccatgtaatgtctgttgttttatttatttttcagggctctttaaatcagctcatctatatttttacttcaatggcttaatttaaaagggaaacattactcctaaattagtggaaaaactagtataatttgctataaatggaaggtaactagaaaaataaacagagagctattaatttctataaagtctgtggagttatagcttaaaatcatcttgtgagtcaccagtttgcatgtgacactttggaaaaggctgcaacagagaagttgagacctacgctttgcctggctggctggcaagactttgtaaaggaagaagaggaaaggtgtcccaggtgtgtgcacagcatggagaaacgtgcggaggtggatggagggcagagcgtggaaggcagagaggaaactgatacctacctgattaaatcaccgaagcacattcagttccgtgccatggatttaacatggactaacacactttggaaatactttcaaagcaaggtctgcaacaatagtgtttttgtaactcctagttaacaagaaaaacaacagatccaagcccccacggcggttccccagtgtttcccaatactgtcatctgattctgttttctgtcagggaaataaaatatcccatttcctccatgatggtgagttctgaatgcagctgtccacggtcaggggagatggagaggaaagaagccaaaaagcagcaggcaggcaaaggccagtgagaagatgttgactctggggccccgtccttcactactgtgtggttgcgggtgtgggtatggatgtggatatggatgcgtgtacagatgcaggtgtgggtgtgcatgcatgtgtgtgagagagaaaacctcctcctcctaggctcaccccaggccatcaaagagacacacataccttgcagaaagtcaacttctacactggttggggcaagtccagcccgtccgaatcccacagggaagggccaccatggcttctaccccagccgagctgacatccccaaacacagggactttcgtatgtgtgtccgactggccttgctccctgccagtggctgcctcttcaggggccagaaaccctgatcgtgtcaagcagtcctagaaaaaatgctcacccgctttctcagatgaagtgcagtagggctccctggcctgcacaagccagtgaccatttttttaaaagcccttggaaaagaaaggcatatattctgcaacacaatatttggtggacactatcatagcattttgtaagatcgtatgtaaccccaactgtggctctgaacaaaaaaatattattcagccccagaaaggcatataaatccctacaaagtacagggtgggttttttgggtttttttaagtggttaaattctcacaattttttgcctttgttcagtgcagggagacagtggtctgcaaaggtggtaacactgacttcctgagaatcttttttctttgagacagggtcttactctgtcacccaggctaaagtgcagtggtgcagtcatggctcattgtagcctccacctcctgggttcaagccagcctcccacttcagcctcccaggtagctggaactataagcacatgccaccacacccagctaattttttatagagatgagagggggtctcactgcattgcccaggctggtctcaaactctagggctcaagcgattggccagcctcagcctcccaaagtgctaggattacaggcgtgagccaccatgcccggcctcctgagaacctttaattgaacttgcagcattgcaattcagcccaagctccttgggtgcaggacttcacgttgctaaatccagggaagcctaccttggttacctgggaaaatggtgtgggaggttccttagatctctccctagccacctgctccttaaaaacatcacaagaggttgtgggaccacaaacccttgtctccgagaattccttcttctctccaaacttgccctattcacacattcccgatcttattttttcctgagtcctactttgtctgttccacattttttctttttctttttttttttttttgtgagacagagtcttgctctgtcacccaggctggagcgcagtgacgccatctcggctcactccagcttctgtctccagggttcaagtgattcttctcagcctcccgagtagctgtgattacaggcatgcgccaccacgtccggctaatttttgtatttttagtagaaacggggtttcgccatgttggccaggctggtcttgaactcctgacctcacccacctcggcctcccaaagtgctgggattataggcgtgagccaccgcacccggcccccgttctacattttaatggccctcaaatctgtcccctcctttcctttcccactttccctgtcccagttcaggcctttatcataactcccctgaactgaatgtccccttttctgattccttgcctctaggctcacttctgcaatccattccccacgaagcagccagagtgatcatctcaaactgatcttggaccatgctcttctgctcctcaaacatcttcagtggctccccattacctacacgatacatctgaagctccctgatgtggtctacagtacctgggcctgtgcctgccttatcagtcccatcccctgccaaggcctgctcctctcttttacatctgacactttggaaaaggctgcaacaaaggagaagttgaaacctacgctttgccgggctggctggaaagactttataaaggaagaggagccttgtgctccatgaatattgtatttcttgtgattttctgacaaggctcaatattttcatctctgttctctgtcgggaatggtctttcgtgtccccttatcctggtcattcgtggcctgctcacattcacccttttttttgggacggagtctcgctctgttgcccaggctggagtgcagttagttcaagcaatgctcccgtctcagcttccaaagtagctgggactacaggtgcccaccaccacaactaactaatttttgcatttttagtagagacgggctttcaccatattggtcaggctggtcttaaactcctgacttcaggtgatccacccacttcggcctcccaaagtgctgggattatcattcacccgttaaggtcatgctgtgggcaacagctcctccaggaagccttccaggagtgttctaggttatactgcccactcctacatgatcacagaactgataacactccgcaagggagaaacatcagaaatctatcttacaaaaattcaactataaacagtcaggagggaaaaaagagagagatagatggtgacacaaatcatttaaataatgtggaatcctgtgcaccacttgactctgtgagtatataccctgtgatgaacatcttgctatgatttctctctccatctagcccagagtcatttttctggaatctgtgagtttggggatctatggagagagaattctgggggtcttcgaacttgtacatacccgctgatgaacttgtacatattcataattattttcactaactctaactgaaatttagcatgaccttcaattatgaatataggcaacagactgcagtagtattagcaacacccgagactttgacaccaacagaaattgcagatattttcatgtcacattgctttggtggcagatgtctccaaatattgtttatacttgtcattacttcaaaattagggtagttattagacctgatgccaaatctactttaatgtgttaataaagaagcaaatgtattattactccacagttttctgatttttatatatactttgacggctgtacttcaatataaccactttcctttttaatcctctgcatttttttgcatttgaaaatattcagagaaggggagcataattttgaccagattccgaagggatttacaacacagagaaggtgacactatcctgctgtagacagtgagctcactggtggcagggcaccaggtccttcatcttccaatccccagcacctaaagcagtggttagtatacaataggaatttttaaaaaatgaactgagatattttatctatctatccttttttccctccttccttcttccttccttccctccttccgtcttttctcccttccatctgtgtatccatcatcatccatccatcacctatccatccatccattcatccatcctccatccatcatctatccctccatcatacatccatccatgatgcatccatcaccccttgtccacccatccctctatccatccacccatccctctatccatccacccattcgtccacccatctattatccactcatttatctacccactcacctctctatccatctgcccacccatccacccacccatcctgtatccactcatccctctatccatccgcccatccctccatccaacatatatccatccatctgattcaatctacagttctaacagttgacacctctgcagttggtttcccagatccagttctgcagctcaactggagactccctaagaaggaaaagtgactcactgtggaaagaggtgatactatttccttgtatggccgtgggcatgtcacagaatgtgcctgcagctcagctgtctttcacaggctgaacacagagctctgtctccagctgccaccacatgggctggggccccaagctcaggcagagcgccatgcctgtgttcagatcatttccttacccaggaacattttggttttctgctttcgaggtatcacagaatggttaaatcttaaagaacaatcgccaccattaccaattacacaaactgcacagaatggtagttaagagttctgcgtaggtccaaagaccagctccccactcactctctatatgaccttgggtgactcagttaaccctttcctctctgtgcctcagttttgctatttgaaagagggcataacaaccatacctcacttacacaggtttatggggagattaaagagaatcttccttatgggaagactgagttaatccatgcactgcacttagcacaggggctggcacatagtaaatgctcaacaatttttagccatcattatccatcatttcctccaaggaggcagacaatcagaacattaggacccagaatcctgaaaaatggagctatggaattcacaaataccccatgtaaaaaaatgcttagatccactcatatctaaaattcaaatcaaggcagcaagatactgtttttactcattggtttgtcgaagattataaagatggacaatcaccagtgcctttgaaagaggaaacaggaaaccacgtaaggctttgaccggagatgtgaagaaacctcctcataggacaatataaaatttaaaatgcacacaccctttgagccagtgatgttaaatctagtcacttaccctacagaggtacatacccaatcgagcaaaggtgtatttacaagaatggctaaaggcagcatagtttaaaatagggggaaaaaaaccaatctaaatgtctaccaacaggaaatcagtgaaatagatgatgaaatatttagtgcatttaattaatctttattgaacagctactacatcccagagactgtgacaggtgctgaaaacagaactggacaaaatagaaaagttaaaaataacgacgaagaatgatatgtgctgacaggagatgagtgataagatagagaggaaaagcaagttaccataaaatatgtttcagaaaatacatgtcataaaatatgatgttccatttcaaggaaacaggttcctgccaatatgcacatgaatacactcatgtacacatattaaattggtgcacaaagtaattgcagttcttgccattacttttaaatggcaaaaacttcaataacttgtgcaccgacataatacaagttaaaatgcaaaggaaaaatctggaagtagtagcaaaaaaaaaattaacagcagttatctctgaagaataggtataggaagtgatgtgcttttgaatcatttaattgttttcatcatgtgcttgtattgcattaatcctctgtaggtcccgtatgctctatctcctttcagaacacatccagcatcaaactatttcatttttaatttttgtgtacacggagtaggtataaactacttcttttggctttcactattaacactctggtccaaaccacccctgcatgtcccctaacagattacaacatccttccccctcacccatctccctgttcttgcccttgacccattacagtacattttcagcagggcagccaccaatcccattttccaaggcaaggccatgtcattcctctgtttaaaatcctctgaagacttcccagtgtggagtgaagcaaggacccttctaagtttcccaaggttctaatgatctagcttcacctccaccgcccctctctcccttactcatgctgttctagccacaccaggctctgctggcaaccaacacaccaaccacattctatctcagggcctttgccctggctgctcctgttccttcctctttctgcagagctccaccactcatgcttttgagatctttgctcaaacactgctgcatggaattgtctccaccaaaggaaaagggcaacctatctccaactggccttacctagcccacagtcctcccctgctttgctctcccatgctctcatcgccatctgacatgacatatcaacatgcatttctcggttgggcgtggcggctcatgcctgtaatcccagcactttgggaggccgagacaggcagatcccatgaggttgggagttcgagaccagccgggccaacatggtgaaaccccatctctactaaaagtacaaaaattagttgggcgaggtggcgcgtgcctgtaatcccagctacccaggaggctgaggcaggagaatcgctggaacccgggagacggaggttgcagtgagccgagatcgcaccattgcactccagcctgggcaacagagagagaccctgtctcaaaaaaaaacacatgcgtttctcatttactacctgtatagaatgtgtgctcagaagagtaagaatttctgtcatgttggctgttgtatctccagctcctaaaacagtatccagaacgtagtaggcactcaacacatatttattgaatacactgatcaatattatcacatgataatatgatatgctattgataattgcgatgatgaaaagcaaatccagaaaaaaacttcgagtccctaaagaaaaatgtttataaaaacaaaacataaattttgaaaaaacatgtttccagtcacagctgcccgcagagaacagggtggaacacccaacaagaaagtaacacgtaaacacctcacggccaacatggcacacagcagcctggttgtctcaggcagctgctctgcacacaggaccctttcacagagtccagggagtaaatgccagcaagggttgaacatgttacaacgtcagcccctgaagccacagactattttcgggtgtcaggcaaacccacaatctcctgtgacagccaaactactgcagatctgaaaaccgtctccctgcggtctttcaggggacaggcctccgggattgtgccacgaactcctcttgcttcacggcacccagtgcctgctgcatcaacagcgactcaggcataggtgggcttggggtctccatcccccagatgtgagctggaggccctacatccttttgtgcctcaaggttgtgctggcgttttagttttaaaatgaaaaaaaagaataatttgagacaggatctcgctctatcacccaggctggagtgcagtagcgcaatcacagctcactgcaacctccatctcctggcctcaagtgatcctcccacctcagcctcccgagtagctgggactaaaagcacgggccactacacgcagattatgttttatttttttgtagagatggtcttgttatattgttcgggctagtctcaaactcctggcctcaggcaatccttccaccttggcttcccaaagtgttggcattacaggcatgagccaccatacccagtgtgcttggctttttaaatgagaagaggaatcaagagagcgttcttccgtacctcatcacacccacagtgaaacacttggcacatgctatcttgtttgtaactccaggtcacatgaggtcacttggaagcaaaaaattaaagcccaatgacatttacagggaggcgttcaaccagcagacttcacctaaacgtcaccagctccgtctcattacagtcaacgggtgttgatttttacacattctctgctacccatacttggttaggaccgtggttttcagctcaggggtgcttttgctccccagagatattcggcaatgtccagagacatttgtgagacaactggaggagggagtgtcattaaaatctagtgtgtacatgccagagatgctgctaaacattctacaatgcagagaacagcctcacaacaaagaataatcctgtcccaggccgggtgcctgtaatcccagcactttgggaggccaaggcgggcggatcacgaggtcaggagattgagaccatcctggctaacacggtgaaaccccgtctctactaaaaaatacaaaaaaaaaaaaaaaattagccgggcgtggtggcgggcgcctgtagtcccagctactcaggaggctgaggcaggagaatggcacgaacccgggaggtggagcttgcagtgagccgagatcacgccattgcactccatcctgggtgacagaaggagactccatctcaaaaaaaaaaaaaaaagaataatcctgtcccaaatgtcagtagtgcccagatcaagtgaccccaggttagtcagtccacagggtaaacaaggttgccctggggaagggagtcccttaagcactgtagtgaggctggaggcaaaagaatggggttgataagatctggtacaccttggggcttttgagatgtgtcttcgcagccaactgtctaaggattctttttttttttttgagacaggtctctgtcacccaagctggagtgcagtgtggtgatcttggctcactgcaacctctgccttccggattcaagtgattctcctgcctcagcctcccgagtagctgggactacaagcatgcgccaccacgcttggctaatttttatatttttagtagagacggtgtttcaccatgttggccaggctggtctcaaactcctggcctcaagtgatctgcctgcctcagcctcccaaagttctaggattatacataggcgtgagccactgcgcccggcctaacacaggcaagtccactacctggccatgtctgaacataccccaggccagaaaaggagcttcctcagcctgtgggtggcagaggtgagacccaaggggccagctgttggcccgtttttatttccttagaagatgtctcagcctctgctactctgaccactcgtcatccaggcagttctgggcttcactcatgtggtgacgacacagttcatctctgaactgcacgcaggcaaaaaatgtcccagcttgctcttgagacaagcacctagtttggctgccaaaaacatcctggtatttcaactcgtgctgcttccctctctgtaaagaggaaaccagctacctaaacagaggaggaggaacattccagagaaggcacaaagcaaatccctgcagagaatgccaaagtctttgccctctctgtggcacagggatgcaggaggcagtgcatggaggcacggaggctggagagcctctgctccccaagcctgctacttccacaagagagaaaaggcagggggtgacgcagcttgcattcacaagtgacaagagggtgtctccagcttatcctcttagcagtcctcatggctgctttaactagttgggaagctgaagctcagaagctaaaagcctttctcaaaggtgatgcactgagcaagtgaaagagttgggattcaaacgtaggactatgaaagtaatactaagtgcttaggtgccaggcactgttctgttgcttaatgcacgttaacccatctgatcatcccaacaagtctaggaggtggctactgctgttacttcaaccgtttttatttattattattatttttgagagagagtctcgctctgtcacccatggtggagtacagtggcttgatctcggctcactgcaacctccatttcctgggttcaagtgattctcctgcctcagcctcccgagtagctgggattataggcgtgtgccaccacacgtggctaatttttgtatttttagtaaagacggggtctcgccatgttggtcaggctggtcttgaacacctgaccccaggtgatccacctgccttggcctcccaaagtgctgggattacaggcgtgagccaccgagcccggcctactctgaccattttttaaagaaactgaggcacaaagggatcgctggcgtgtggaaggtctcacagcagctaagtggtgagccagggggtctgctgcatagaccatgacctgcccccacgaggcccgttctcacctccccaaggggctgcttggggttaccaggtccagactgcccttgtccactttgcaggtgagaccctaggaggatccagagtcctgagtgtgcaggggacaggacaaacaatacccaggggactgtcactgaggtgaatgaacgcagcaggccaggtggggacttctatgaaccagtgaccccatcccgaggccccatgcaaaggggcagctggtggtcaccagtcatggacatccagcagctcagagtggttttacctatcagtttttcaaaaatcttccaaccccactcttcccctctctaaaaatttaaaaaatttaaaaatcttcctgaggccaaaggcaacccatgtgcaggtcagagatggccacgaggaggcccatggcacaactttgagtccagggccatgaaatgagaaagtcacctcctgctcccataactggtgcctgattctaactgggccagtgaacgtggagactggtcatctgaccaagaactctctttgagcccgttttatagctggaagttccttcttctagcattgagctggctgggtttttccttctcaggacaataaaactgcatttctgtcctcgaccccacccatctggcacctgcaccacagctaacttcagctttccacccagttctcttttgttcagtggaaaaaatgagctacagttcccagaagaaaatgagaacggggttattattaataagatactctttttcagaaaggcagttgaaggcagcggggaagatcacattgaggggggagccggggtagccccactgctactccctcctgcaggaccacctggtctggagaagcagctacgcgctggccctccctgttggctctcagaggtacaaaccagaggtggcggcatttctaagaaattagattcaaatactaggacagttaacatttcctggaggtgtgaccgagaaccaagaaaaagtgattttgtgaaggccttgcttgcaggcagaaataacctgtcttctctgtctgtctgtctgctctgggggctaccggaaggagctgaaggcctgtcccccgcctctccccaccccaccatgccctaggccttagtccctccccactgaagaatgcctttaccaacttgggacagacagaggagtatgaatgaatgagaatactccaagctgaccctgcctggggcatctcttctcacacatgtggcttctctggtgctttatttagcatgagactgtttagaatgtttatttttggctcagttttgggggacagttttcacaaatagaatgacagctatgatcttctctctaaaaaaagagctcgtacaatccaccgttgggcattcagtttcaagagcttcactgtcccatggtctccattctgggacctctcctccactggaagaccctctcctttaatcaaaacatgacacaagatgacagtgactccccatggcaagtcccattggcagtgctgagccagcgaggcgggggcccggtcagggtccctgaaggaaagagatgttactctccaaactgaagagactgtacaaagagattctttataaggaaaactaacaagggaggtgctatgcaccagggctggccacagccaggagctgtcaccaccctggggcctgaaggggagggagtggtgttcctggaccacggagacagtagctgcagccacgggagagggcagccccacagcagctgtggccttgctaggggtacagacacagccaacccatggaaaccctcatctcatctcttcccaccttcctatctcctaccagttcctctacttggccaaagcaaagaaaagtccttgctgatgaaacccatcaaggttagcctctggaggcccagagaagaaaggagaggggtggagagtggatctggggctggggcttgcgggggaagaagacacccaacatgtttcatcttgctaacacccaacatggagacagcaggaggaggcacaaagagggcgtgcggggctgtggatcttccacgctgagcctccacctcccactatccctgagcagcagaggaatcctggtttgctactgagctgctgaacgactgggcaaattgttcagcagctctgggtcctggtttccttccatgtcaagtataaagatggaacccaacaggccctaaggtatgggagtcacagccagcactgcagaagagggaggcctaagtgtgggccctctcaatgccactcccaaactctgtggtcttggaccagggactgagcctctccatgcctcagtgtcttcacttgcaaaggaagggtgtgagagcaccttcgccaagggatgttgttatgaggaaacgaggtcacgcatataaagtgttgagcaacatcccaggcacatagaaaacatgcaatcacccctccagctctcacgttccccaagtttgggccttgtctacggatttttacatccctcatacacctggacctccctcgtgctgctatcttttgtgaaagcaattttcttcattgaatgattccattaactagaacctgcaaacccagcctgaacattctagcatcgaaaccttctcttttaagctccgcagtatgcacagccctgccccaaaaccccatggagaagatcgcttcagcttcaaagatcttggtgcgtgtgctatttatgccaaatgttagtgatgcctcctcgctgagcctccggctcgtaagtcaatgcaaaaccagccacactgccttgttgctcagtggcagcaccacgggcttctgcctcagtgcttgaagtcaatggcggtgggggtgccctgagagaagatgcgtgtgctggaagggaaatgtgagtatggcctcctcaaggtgccactgctgtgctcaccgtctgcagggcaaaccgtgccacagcctggggcttcagctactcatcctagaatccactctgtatggacagatgtttccaagcccatgtgctctggattgccaagtgagtgatctatagcaagcaagatctaatctatatccacatctaatacatatcaaatctctgtatcaataaatagatatcaaatctctatgtcaattctttgtgtcaaatctgtctagatctaatctctaatctccttctatatcttattgatatctctacctatcttgtaacatagcagggaaggagacagatttcatttgtcacctggctctagtttagattctatcacctactgaccgtacaacttttaaaaggaaacttggtctctctggctttagcaggctcctctgtaaaatggggttaaggttagtaactcccagggttatttcccaatatatgaaagctaaactgctaggttcaaatcttgctgcctttgctacctgttgggcaagtaacttaacctctttgcgcctcagtttctcatctgtaaaacggggatgacagtaatacttcccataagagatagttgtgaaatgcaaatgagcaaatccatgtaaagaacttaatttagaagagggactcgcatgcagtataaatgcttaattcatgttacataaaagtgctaaatttatgaatgcatgtccaatgtacagttcccatctcaatgaaacatctattcagtgtatgtaatcattattgacaagagtgatcttttttttttagacggagtctcgctctgttgcccaggctggagtgcagtggtgcaatctcagctcactgcaagctccgcctcccgggttcacgtcattctcctacctcagcctcccaaatagctgggactacaggcgcccaccaccacacccggctaatttttttgtatttttagtagagacggggtttcactgtgttagccaaaatggtctcaatctcctgacctcgtgatccgcctgcctcggcctcccaaagtggtgggattacaggcgtgagccaccgtgcccagccaagagtgatcattttaagtgttctgagttaagggcttaaattcaaactttcaatgtcttcggtgaagtccactcccaacaagaaggggggaatggtgatctcaacacgatctattttttgaaatggtgcatgtggctgcactttggggaacttgctggctatttgcggaatgttgtatcacatcattcaccctgagtcatacagactagagaagatcccatggccaggagatcgcagatcctctctgagaatgactccatgctccaagtccagactccctgtccattgagccaagtctctgcccaggcagtggtctggctggtcacctccctgccccaccagggctaactagagaggcagcaaatcacagccagaggaaaagattatagtaaagcaatctggtccctccccaaactagccttctctgccccagagaggttcttctcccataaggaggctgacgggggaaaaaaacatatgggctgagaagcaatttagtctcaccatcctctcaacagatgctgggcaccataagaattaatgggctggagactcaggtaagagccattcagaagcttcccgattactccaaaaactgctctctgtggaggaaaaggttaatcgaagcccagagccggaagaacggagaggagacagcaattgtgttaatcccaggagaggggaagagcttcacaagaaagaagtttgcacaaacaagcctgtggtctatccctgaaagaagaaccaggcctaaatatcaagatatttgaaagatcttctccatcagtccagagaccttggcaaacccctctccaaaccccagccaagtagctggattaagaaaaaaaaattttttttttaactctgcacattctttgcactagtaagccataaatctcttaggaaaccatctcctgatgaggtttcttctcccataatgatccaacagaactcagtttttaaacacatgatgtacatgttcctgtgtatcatgggtcattgtgtacccagagtcagtcatgtcaatgcaggtctggacacattagaagataaatgtgtcggccaggcatgtggctcatgcctgtaatcccagcacttttggaggccaagatggatggatcacgaggtcatgagttcgagaacagcctggccgacatggtgaaactccatttctactaaaaatacaaaaattagccaggtgtggtgtcacatgcctgtaatcccagctactcaggagactgaggcaggagaattgctttaacctgggaggcagaggttgcagtgagccaagatcacaccattgcattccagcctgggtgacagagcaagactctgtctcaaaaaaaataaataagtaaataaataagatgaatgtgtcacaaccacagcctacagctggttaaagtctgaacttaaaccagaaagggtgatgtttgaacataaacaagagaacaaacaaggaagttgcaattgtatggctggaagtgtctttgtaaaataaactgtcctcagaacaaacgaagttactccagggtttcctaaccttgccactactgacatttgaggctttttttttgggggggggtgctttcctgtgcattatgggatgtttagtagcatccctgatctctacccactagatgccagtagcatccttcaccccgaagttataataatcacaaatgttgggccaggtacagtggctcatgcctgcaattccagcactttgcgaggctgaggcgggcggactgcttgagcccagaagttcaagaccagtcggggcaacatagcaaaatcccacctctacaaaaattacaaaaattagcatacacctgtagtcccaactacttgggaggctgaggtgggagcccaggaggttgaagctgcagtgaaccgagatggagtcactgcacttccagcctggttgacagagtgacagagcaagactctctcaaaaagaaaaggaaaaagtctcaggtgattgtcagatgtctccttggcggtcaaaattgacctagttgagaactactggtttatacttaagtttaagttcagctgaacatcagtcagctaattagctattagccaaatttcagacatcagcccccagctcagcataacattgctaagatctaaagttcctccagccttccaaatgctcacatcagacattagtttcactggatggccctgaatttaagcctctctccttctctcctacctccttagtccttttctttctcccctgcctgataaagtaattctttattcatcttgacattataatgacacaaaagcactgaaggagcaaatgccttaattgaatctaagaataactggcattatttttataggaacccagacatactacgcaaaaaattcagaactctgtcattgggtctttttgcaaggttaacttttaactgtaagctcctcagcacatctcacctcctgggctcagaagctcaaacctcatctctccagctcagattcccccactacctgggagattttacaaccacctccactctacccagtcactctcttacaaacatgtttgtcttatttccatccacttattactatctgaagttacggatgcatttattaatatctatttgtacctttttcatctgactctcctagaatggatgctttctaggcaaggaaacttctgtttttctctgctgtatctttcacagttagcacaaggccttgtctccacatggcccaatagtgatttacggaataaggaaatagatgaatccctttacatagatacaatttctcaagtattaacttccattcatatcactactcatttgctacaggagccctgttcacaatcatcatggccccagcatcatctttaaatcatgtgaatgtcattcccttccctctaacccaagttagctgatcaaagaaattcaagtatctggttggttttgaaaacccagaagttgggagttttcctcctgatgcctttgatctccaggtcctgagggggatctcagcataaacgaagacctgcttccctctaactctagctgagttcacaaatacccagattgacaaatcttgactcggcaaaagagctcctttattatatctcccaacgtatctcagtgtttgagtggaggccattagctaattgacagagagcctgttgagggtgggggaagtgagggcaggaggaggcagagacactagaattaaatggcaagagaccttgccagttggagtggattcagaaatgatcaactgtcttggggatcgatgagaaagaaagaataaagtaataaggattccaatgtatcaaaacactactgatgcgcagggacatgttttgcttttgttcttttaaaataaattttcattcgggtccattgcttaaaccattttacccccaagccctctgacaaactgtcaaagataactcactgcgcaaagcattgaatctttctatccatctacccatcatgcatctctctacccatatatctaagtacatctgtggatagttgtgctaggcactgtctatctgtccgtctgtctatctatggacgttggattgcatataccaagcccatttctccagctttgcctgaatgttagcaaatctttctactagtcaaggcaactttattttcttgcaaaataggaaagcagttgagaagataagattctgatgtcatgcaaccctgagtctaatgtgcatcaacactatctgcttcctgtgtgaccctgggcaagttacttagcctctctgacccttaggtacctcatgtggaaatcgggtatcacacaaacacctgtgtaaccatggcatttgaggataaaatgagagaagtcagttcttggcaaatggtaaatgttagtaagaatgaggataagaataatgccacctagccactcactgaactccttttttatttttttttcatttctaggtcacctgattcgctggcagtcaccatctggagaccagaggagcattcatcactgcaagtcagggcttccttggtgcctccccaggggcagcctgccgagccgggaagctgacaccagggatttaaaccttcctcggcttcctcattctattaatctggccgttaagcagagagtcctgctgatgccaacagatgcaaagctctgctgtgctaatggtaaagagcattagaggagtcctcagcagccaatcaatccatctcccccaactcagaacagctgcacagggacagattaaccaagcgatggctgaggaccgttgcaattcacacgagggagagagggatgcgtgaaggaaagggcccctgcacagccgtgttctaatgcaggccaggtcttggacaagcaaagcggctgatgcattgtgcaaggacacagctctcagtgaaatctaacaggcaggctaacctgtgacagctgggctcaagatggagcaggcgatgctgtccttagaagccaagtgcactgggagaaaagcgggaactgacccagggctcagggtacatctgtcacctaacctctgcagagttaattcttccaagcttggccacatctgccatcttgttcatggcatatgggtaacatttgaggcactacttcctgccagaaagggacctgacccccttgtctgacctgcctgcaggcagctgaacaggatcccatcattcacctcacaatgggctgaggccagcacaaagtcagatctggccacgggcttgtgccaacagtcacaaagaaacatttgcactttggttgggttccaacatctctttaacatgggaaatcagaactcggggagcgagaacaatattcccaggctccccaaagacagggaaccaaatgagactgatggagcatcgtttgcagacaaattgaagctcttccccaatggcatagcacaaatgctgagagtctaccttgtgccattgctggttgcagatggaggttcaggtcccttgggctaacagattggactttaagagtcgccactgtgtaaggagctgctgctggaagcctcaggtgctggccaaagccactggtctgcaactcctctttcccatgagggttttgaagggctgatggggtggtgtccagagtgaaggatacaggaaggtcaaagacagaaccatccagggattctgctgttccactcccaggagataagatttgacttccagagttccggacacagatgttcgcccatgggttttcataagtttaatagggtatccttctggggaaggataaggaaaagaaggaccatcattttaaaaacacaccgtggaagttctctcatagtccctggggtagactgggtagagacacgtttcccaaagggtagcacacacatctctgataggaagtttaggtgacatcagagggtgcgtacaggaacaatattttcacagtttaatatctattttaatgttgtgcaaaaaaatatataactagcccttcaaacttgtggttccatgaatattattgcttgagacagtgtttctcaatctcaacaccattagtatttagggctggatcattcttttttgagaccgagtctcactctgtcacccaggctggagtgcagtggctcaatcttggctcactgcagcctctacctcctgggtccatgtgattctcctgcctcagcctcccaagtagctgggattacaggcacatactaccatgcctggctatgttttgtattttttttcagtagagatggggtttcaccatgttggccaggctggtctcgaactcctagcctcaagtgatctgcctacctcagccccccaaagtgctgggatacaggcgttagccaccgtgccaggcccaggaccagataattctttccagtggggagctggcctgtgtgttgtaggatatttaacagcaacctgggtctccacctactagatgccagttgtaaaccccccaaccagatgagaccaccaccaaatgtcttcagacgttgccaaataaccactgggaatcaaaaccaccccccggtttagaaccattagattaaggtaagtctatttctgaaagcaaagtgagttatgttaaggaaaaatgtatttttaggtgactttatagaatagatgaaatttacataaggcaaaggtggtcaaggtgataaggacagacaaaaccaagccagaggacagccaaacaggcagaggaaaccgaatccttttcctcctcagagctgcaccttctatacttccctgccggccctggcgcctggtcagccctggggcccccgtggctatacctgtgtgccagagaatgcaaggacagaaaagcacaaggaaactgtgaagatctgctggccttccccatcagggaggaagcaaggaaggtctcctcattcctcttaggagaacccaagcagagatgccaaggagagggcaaggacccaaggtggaggaggcaaaggccaggggagcaggtggtcttttccagtccaccccagaaacccttgaaatcgctgagctgtcattcagccttgaaacgttcgaacaggtttgactgtgtctgacacttgcaagctattcactgtggggctctgaacgaggcctgtcctgtctgcctactctctttactgtcagccaaacccaaagagctaaggaaatgattaatccaaagataagaaacgtccccttcagatccagcaggaaaagtaacagttctattggtttaaaaagctgccacttgccggacgcagtggctcatgcctgtaatcccagcactttgggaggccaaggtgagcggatcacaaggtcaggagatcaagaccatcctggctaacacggtgaaacctcgtctctagaaaaaatattaaaaaattagccgggcgtggcagcgtgcgcctgtagtcccagctgctggggaggctgagacagaagaatggcgtgaacccgggaggcagagcttgcagtaagccgagatcatgccactgcactccagcctgggcaacagagactcggtctcaaaaaaaaaaaaaaaaaaaaaaaaaaacgctaccactcacaagcacttagcacgtaccccggactttataaacatcatttcctgtgaccctcaaccacaactctgcaaggtgggcactatcactgggatgacgtttcagatgcgaagacactggcttagacattatgtggccccatgaacactgcagggctagaagacacagaggtggaattccacctggctctgttgaactccaaggcctatactcatagctgctgcactgtcctagctcccaggaaggcagaaagcagacagtcagggccgtgccctcccttacaagacccgctggtcatcctcctccccacacggaaatgccactgcaatcacaattcctcagaatggcctaacacgcaagcagatgaaagggtgcaacttccttccatatgctgccctcactgccaaggaataaaagtcctccaagttcaggcatcaaagagtagcatcttcccacttcatggctctcctctgtctcctctctcctttgcatgaacctccgcatgatggttgggcaggagcgaaggacagacgaaaactcaaaagaaatgattatggttctcgccacaggtgggaggggcaccagacacctgggtgcgaatgtgcacccatgcacacccacaccattgcacacacgtgtacactatatgccagtgtgtatacatacatgtgcaggcacacacacatccaaatgggaccaggggcagccatgggcctgtccagcctttcagagccacgggacaagtccccttgagagctggaatactaaggctgagataagtggccaagacaggaaagatacttacctgagtctccagggtgatgagcggacttgggtgtggatcctgtaggatgaaaggagaaaatgcacgtgaggagtgaaaaaaagttaacttactaccccagcatctttttctttctttcctttttttttttttttaagagacagggtctcgctttgttgcccaggctggagagcagtggcatgatcatagctcactcactgcagcctcgacctccagggctcaagtgatcctcccacctcagcctcccaagtagctatgactacaggcatgcactatcatgccaggcttttttaaaaaattatttttgtagagatggggtctcgctatgtttcccaggctgttctccaacactttggcctcaatgatcctcccacttcggccacccaacgtgctgggattataagcatgagccaccacgccaagctcccagcatcattttcaaacaaagcttgatttccccagtggtcaagccaccccacggggagggcagcccaacctgtgtcctccattctacagagacatcaggacagcttggcccagtctgcaggccgccccaacacttcctctcacgcacaagtgatgaaagaggctcaagtttttatgaaggaaatgcccacatggagatcacacaaaacaacaaaatgtaaagaaaaaagaaacaaggcacccttgccaaagagctcaacgtgtatccaaaccctctataaggagagtttggctccgtaagaggattaggaataaaccagaaagaatataaagtcctgactaggaacaaggccatcatcaatttgtgtctgatcttggaaagaacaagggaaggaatgagagcgagcagcttaatttctggtttgaggagcacattccatggtctggggaaggtctttttttaggatagagaaggccagagaaatgtcctattcattcactctgtacaaaagccgattgactgggaatgcttggtggtactgtctcgggtcattaagcatgaaccctttgggttggaggagagacagggagggtacaggaggaggaaaagactgatgggaggagttggtggtgtccagtgagtggtttccaaagaaaacaggaaacccagcacatgaaggctatttctgtctataccacgtctgctctgaacttaatcatcttggatttataattctgggaaaaacaacctcaagcttcctctgatagagaatgggcatgattttagggccctgaagtacacatccagtttgaagctttgctttgtcttagcagattttccaccacggggttttaggaagccatgcaaattagcaccagcccattgtcccatactgtgagcaagaaggaaatgcagggaaattggaactttctaaaccccttctctaggtgagctgccattcactgtcttgatgactgttctacggtatctttgtaatgatgcccaattctgaggagtgtaagaggcacgatctcagaaatacggtgagctctgctcagctctgtcctttaggaagaggaattcgtcgtcccccaactccaattctgagtccaactcccagtaattctccattggtgtaactgaaaggaaactgccaagagaacatcccactctaattctcacattcccccaggcattgagtcttcctcatacccaagaaaacatggaggggaatatgttctccccgtctccccacattgcagccttgacctataaaggaatctggggaagtcatgaaggagctgttttgggcctgtctcttcaaatccttactgattccttcccaggggtgaagaagtggcagctaggattggtaaaacccgacattcatagagcaactttcttttgatcaggcaggttttgtatcactcgcatgcagaaagagtctactctgtacttcctgtttccctgtgttggggcaggacccatttttgtctttgggaagcaagaccatcctcctggtctgtgggtggcagcatgagtcagacctggtacgagcttagtgggcgagagcatgcaacatctgctgttcaggtcagagtagtctgtgtctgtctgtctgtccattcagatcttaccacctcgattttgattataagataagaagctgcatctcagcctcaaaattagcctcaatctccaagccaagtgctagcaaagcaccagactggggtgttgggtgcatgcccagattaattaagctgtacttcacagaccatttggctattgtctgagacttaatgcttcattgcttagaatctccaagaggttgaagaggggagaatgccatcctgacccctaaaagcagctccaatggacaagactttccttgggaagtcacaggaaatctctgtcaactgtgttgacaaaatcaaaagcctgatctctagacacagtgaagcatcagctctctatttgatgttccaaaatcagagaccttatcagtgcatggtcagggatccaagattaagaagattctggaaagcaaaagcacaaatgctatctatttagcatcttcattaactaactgggaagaagataaagtcctcacaaggggccacatcattaatacttgggtttcacttgccagcatcattatgctctcctccctctgcacacactggaaatggaagactctccctaaagagcctcagtccagaggattcaaggtatgactatatatctgtgaggtctcgctttcagcaacatcctccttaattggaaaggctaacgaagtggaaccaggtcaatgatgctgtctgcctaatccatcctatctgtctaaattgggactctttggtttacagtagagtaaattcctgtccatcagaggaaagcctcctggagaccaaaggggaatttgcaatgtgcgtgcacgctacagtggagtgcttttagaatcttaatgccggtaccagtaaccatggaaccgcctacaacaaggaaagccctttcctatcatctattgcaatggctcagttggggaagtcaaatggggaaccaggtgcactgaattggtggccctcattcgtcacagctcctagatccatgccctctggtcatgtgactcgacagttctttactgtgtgcttctgcagcccttaagcttgggtttgcccatttgactgctttgcccaatgggaggttagtagatgtggcataagcagaagcttgaaatatgcttaggtgatcaagtgtggcctactgtgtttttgccattgccacaagagatcatgtccccagtaccttgctggtccaaggaggatgccagacacgtgaaacaaacctgtacacaatctacagcgtgcagccacgccccgcctagatcagccgaccccctgccaacacagagaaaatatatgcttgttgtttcaagccactgagttttgaagtcatttgttatacagcattattgtggcagtaactgatatactttctaaacactgacctcgatagatcaaaaagtgttgtcacaaacactcacagactcagaacctaaataatacatgctctttctctaagtctgcaaatgcatcccaggaacctgaaattactacagctaacagcgatcatttatagagggcctcctaggtgccaggccctgtgtgctagctctattattacatcaagcaaggaaataagtgaccatcaggatcttgcatgcctctgaattagccttcaatcctgtgtgcccaatataccagtccttctgaatttattatttagataccaacacaacatgacaggaaatgattactcagaatccttttgcctgaaaatacatacagttttcattcctttggtttattcttaactttgtcctatgggcatattacttgactgaggttctgaacagttgaatactagcaataaatgacatttgttaagttctcactatgttccaggcactgggcttaacttctatgcgtgtatcatttcgtttacccctgtaataaccctaagaggtagatactatcattatcactatcattagtatagagatggagaaactgatgaccagagagactggtaacctgtccgagtcacacagatgctgttgaaagcctggatctgatcccagcatcttacactggagaacactgggttccactctttcacaagagctctgctggaaaatatattattactttagacaaaataatcctacaatttttggataatgtctatcaaaatcaagaatacttacagcaaataagcagtaccaccttaacaaataccgtaatctttttttttttaccatctgtcttttttaaaaaggtagcggacatggttgatagaaattagcacacatatcatgactagaaacaaaacagtcactttgccacagcaaggaaccatgtaaagttagctaaatcaatccacacgtgtttactaagttccgattcagtagctagctctatgcgtggcaggcaccatgagggagacagaaatgagtttaaagtgactctgtgtacactgctattcccaaaggtaactgtttaaataagaggcaggagcctgattacaggtcttagagcaatgaaacttgtctacacctcaaaagtcttgcttgtaagaccaagaagccaggctcaaggccaaaggcttaattttaacaagcaattaagccccaacaaagaaagtagagagaggaggaggactttgttcgttatcattccacacatacatcaaacctatctggctctcctggcggattctgagccctgagctaagcctcagccattggaaagcatgttctcttcctttgctttgaggacattcagaagacagtgcttgttctttggtgttaggcaatgacattggtgtagagataatgacactggaactcacgccttcagagccaggtatctccgtgaagcccaccaaatcaacaacatagacaatggacatttacatgctaccttcttccacagacgctcccagggaacacttcagaaggctggcttggtgccttctctccgccaagagccctctaattaaggccagaactgggaatcttccaccatcaaaagatggtgtctcactgtcactcatcatccaaccaccagataacttggaaaatctaagaaactcttcttgggattgcagatcacagcgaatgaaaactcactcatgactcgagcctgctggagaatgtccagctctagccaagtctgaatgaccagccagaaacctaaagggacactgtcacttagctgcaggcctagtagtgcaggacaaagatgaattattcagtgggaaaagagggcaggtttaggggtcgccccagagttcaaaccatacataaccactgtattcatttgctagggctgctataataatacacaggtgaggtggcttaaacaacagagatttatcctttcacagttctggaggttgaaagtccaaggtcaaggtgtctgcaggtctggcttctgaggtctgattctcctcctagcctgtagagatggtggccttctcactgtttcctcacacagccttttctctatgcatcccgggtatctatgtgtcaaaatttcctcttctttttggggtgccagaaatggagtctcattctgtggcccagactgcagtgcagtggcacaatccaagctcactgcaacctccgcctcctgggttcaagcgattcccctgcctcagcctcccgagtagctgggattacaagtggttgccaccacgcccagctaattttttagaatatttttagtagagatggggtttcaccatgttagccaggctggtcttgaactcctgacctcaagtgatccacctgcttcagcctcccaaagtgccgggattacagctgtgcaccatcatgccaggctaatttttgtatttttagtagagatgggcttttgccgtgttggccaggctggtctcgaactcctgacctcaggtgatctgcctgcctcaccctcccaaagtgctgggattaaaggcatgagccaccaggcctggctcaaatttccttttcttataaacaaaccagtcagattggatgagggccccattaatttaatgcaatcacctcagtaaaggccttatctccaaatagtcacattttgaggtattgggggaggaagggtttcaacatatgaaattagggtgggggtacaattcagtccataacaaccacctagcaccacttgcgaccttgggcaaagtccttagcttctgtgagctttatttttctcactgacccccacgtaaacaggtaggattatacttgccaacagagctactgtaacaaagtggaaaacagattttctgggacctttttgtaagggacactattaataattatacaagcttaacaggtataaacccagactgtcccaggaaaccctaagataggctcctctttgtcttgaacacagcataccactgacatcatgagttgtcgtgaacattaaataaaaataaatactgtacatagttacaacctcagaaatgatcttctctttgatttcttcctccaggcttacaaaggctgagacatatccctctatactcaaccctactaaaccacaagtcttctgaactgcaagttaccgtagatacgagtgcaacctatgtcacgtgacggcagtgaactgagcaaatttagctaattcgttttgaatgcttactttatgccaagcatacgaaattcctgcaacgctgccaagggaggtatcatgatccccattttatagatcagataactgatactctcagagaataatttgctcaaaaacacagggctaatcaggaatggagccaggagcagtaagcaagtttgtaagttgccagaaactagtcctttaaccgatatcctggtgttaatcaaaagtatgaacttactgaatcagaatctctgggcaagggtccaaggaatctacattgttatgaaacacccttgggggattcttacgtacgctgaaccggagagactttacatgatacctaaactctaccatgtgtaatgcaagactgaaaaagcttccaaactgacaaagaatacgattcctgcctctgatccccagccagccatcaagtgtcggatgcatgcgtgaaactcttaagagcgttggtgttcacgctctgcacccccaagaaatttccaggacgggtgcaaagtgttcccttctccccactttggtgaagagatttgccttgccctaaaaaacctggctaccaccctccactttccagcatttcctcctcagggaagtgggactctttttcaactcctccttcttagggtctcattgcagcaaccaaggtgttgcataacggggctttctcttcagatgtccccatgggatttcacactggctcctaagacgaaggctgggcacgtgcagggcaggcggcatggggtgatgagggagggatgccagtgatacagaggtgtccttgttctctaaaaaagactgcatttggaatgtgaatgcaggccagaatcacacagccctcaccttgttggaaaatgtgaactcaccttcaaatagggctcaggggagaaaacagaaaccccacagagagaacaaggggattctcaatgttttacagaaacgttggcagttaaaactgggtgtattgcgcgctctctttctctcttttgtattaaaagcttaaaaagctggtctttctgctatcctactttcattctacatttttttagcccaggacccagaaatgagcagtagaaccttaaaatgaagcttaggcccttggagatggcaattcatcacccacagccttggaagatagagaaaccacagactcatggaaacttgggaattatcttaatgcttctccagcttggtatgtgtatccttgagcacaaatggttatcaaaaatctaaactcctgtatttaatactttgttctgtgtgtgcctcaagaggttttgtaattctttaaaaagtacacagaattaccatcttagaattacaaggttttgaagaaacctacctgaaaagattagaggcttgagctacagagtgttaagacaagaatgcccaactggtggcctgtggatgcttcaagctggtttgctttttttttttttttttggcctgcagccttgatgaaatacttgaaatcattcattgccaatgttttaaaaccaggatacttcacatgcaaatctagatttctcacgtctcctttaagaacagaagatttagcaacactggatgtgtattcttgcaagaaaacagctccagactgagtagctggcctggctactgcaagcaacagaatttatcacccccatattaatgcaaattgcctaaggtcacatagctagtcaatattgacaataatcaaaataccagctaacattgttctcacactgaatgccaggtattactgtaaggggtttgtaaatattatcttatttaattcttacaactgtctgggtgttgtggctcaagcctgtaatccgtggaggccaaggctgacggatcacttgcggtcaggaggtcgagactggcctgaccaatatggtgaaaccccatctctactaaaaatataaaacttagctgggcgtgttggtgcatacctgtagtcccagctacccaggaggctgaggcacgagaacagcttgaaccctggcggcagaggctgcagtgagccaagatagtgccactgcactccagcctgggtgacagactgggaccgtgtcttaaaacaaacaaacaaacaaacaaaccaaccttacaagaactccaggaggcaggcaccaaaagccccattttacagatggtgtaattgaggctcaaaggagaagtaattttttcaaactcattcattagtgggtggtgaagccaggatttgaaacagggcatccttttggaccactaagctaccctgcttcccagtggtacaaccacatcttgaactggaatcattaaaccacagttcctggttctatcagcatctggcactaagaagccataaggagcactgaattggatcagatgctcctcatactagatgttctcatttccttgctgcgagtcttcaggtcgactactttgctttttccagtggttaatggtaataatcatcaccatgatcctctcacactcattgtggagcactgactgagatgttctaccagagcccggctcagtcctgacagagtgggtgggccaccaatgttagttcctcttagaagacaattggcgacactttacagtgttttgcttttcacagctcagaggcatctcagaccataaacaagacctgccacgtgccaagaaggcagccgttacccgacatggcccagacaggaagtgctggctaaatcccaccatgccgcaaatctttctaaaggtggccacccaggctgtgtttgaacacacatcctcctggagctgggaacacacgccacatctataattcatcccgataattagcttttcccaggcacaggccgcagcacctatcaattttgcacccacttgctgtggtcaccaagatggcaggtggcccaactggaaccaatactgccaagtgtcccacagacattgtctggagttccaatgatactatgtgacttctgggactgctgggtgagatctctgttccacaggaaaatagttcatatttgagctccagaatccaaaatcgtgagttcaagaaaagcacttagaggtgcagaccagttatgcagcgaattcacaataagttgcccgaggcagctgttactaagcagtccacctggcctcaaattctcaatacggcccgaggagcagatattattaatagattccagtttccctagatgtccgtccctgacctgaatcaaacccatcactgtttggtgaggcatgggagatccaggaggaaaggcctatttcctaagggccacacacagtttggattaaaattcagtgtagaatgtcagttttttgataccaaatctggagttcatcccattttgccaaaataaatttctatgcacatccctccctgcttttcttcacttcctcctcttttgctccttcacaagagcctctgaccaggacatctattgtcgaagatacaggaaaactgtgattcagcagtgcttcgcgtctggaatgactccaagaggccacacacagaactgccgacacaaaccacggggggcggaaaaaacgatcccaggaggtggggagtggagagctttgcagtcccaggctacagctcgggatgtagagctgccttcctaggacagaagagagacgatgagaacacctggctggaaggtggccctgcaggggacggatgggccttctacatttagagtcaggatggagtcagaaagcttcagcaggggagggactctgcctgcagcctgtcccctcaacctcctctaatatttcttaatgaaacgatagtgacaatgaagatgacagccttgatgacagcgcccagtagaccgctatcattggttaagtccttatgagataccataattcaccatttatgagcattacttcaataaacccacattctatcctcatgaagtggctgttcccagaaggccataaagactggatagatagattttttttttttttttggtttttactttaaaaaaaaaaaacgacagggtcttgctctgctgcccagattggagtgcagtgatgtaatcatggctcaccacagccttgaacttctgggctcaagcaatccttccacctcaccctcccaagtagctgggactacaggcctgtgccaccacgcctggctaatatttcattttttgtagagatggggtcttcctatgttgcccaggctggtcttgaactcctggtctcaagtgatcctactgccttggcctcccgaattgctggaattgcaggcaagagtcagtgtgcccagtttgctttttctcttgatgacattaagtatttccttgttcctggattatgaataccctgtagtactgttcctaatttatataggaggaaactgaggctcagagagtttcaaagacttggttgaaagccacagagccaggcccatttaaccttaatatcttcagagaggtttaaaaaaaaaaagaaaaaaaggtaaccaaaatgcttggatgtggtatggtgtgatctgcatggtgcacaaaaatacttctttttttttttttttttttagatggagttttgcttgtcacgcaagctagagtgcagtggcgtgatctcggctcactgcaacctccacctcccgggttcaagcgattctcctgcctcagactcctgaggagctgggattacaggcacatgctactaagcctggctaatttttgaacaatactttttttaaaattaggtgccagcatttaaaatttagggtgaaatcatgatattctgatttgtggcttttcgtgaaatgtggaaagatctgacccactgggtaggcaggtccacttaaggcaggcacatccccttctgtttgccacaaccccaccctgcccacctgggctgagccctgaaagcatctaagtttatgaccttcctatctgttcaccaccataccttacccctcccccacaaaggaaggtaccatgttaccccatgaacatgactccaaccctcacccgccaacctcaagaagaaaaattcgggatcccgtgacttcacagcagaaacagaaaaactcaaataatccatcaggaagttgagcactgaggttaatacacacaggaccatcttcctctagctcaacagtcttgacttttcagggccgtgacccagaagggaggtgcccgtgcagaaggcagaacaggaagaggttcttagcacccactgttttctcttcctgcacagccgccttgggcagctgcctgtgaacagcctggctgtttttctcctagctctctcggaaggaagtgctctcatcacccacgacaacagagttggcccgaggagccaaaaacgtgcaaaggggctccaagcccagctctccttctgttcggggcagcctcagagacaggaagatgggaagaaagtatggcctgggatagaacatcctgcgagacccttacaaagccccagctgtgggggaagggaacaacaggagggggccagaggaagggggtccaggtcacaccaattttatacaatgagctcctttcatccgtgaatagaggactctccttaactctgtctcaatggctttgtttctgaaacgatcaattctacacccagaaagccaaatttgccagacctcatgccaaggtcaggcaagagcctgagatcccccaagcaagttgataatcaacacgcaggagacgacgctgtgctaagtcccatttggcggatccaaagcttacaacgatccgctttcatttctacgccttctgcagtggggcggggttgggggaccctcgctcacatgcatgccacgcttggtggaactgtaggctgtattcaggagagtaagtgttactttcccagggacttcattgagacatctgcggggagggcaggatgagaaagagctggagaaacaagatgcaaggtaaagtgtgtggtctcacactgaacacgttcatgaagtggtgggaagcaaccctagtgactcagcagtggcctctgtttagccagcactttgagaacacgatcttcatgggctgactgcagaggtggccaacagaaactggaatctacaagcagtattcagctcaggcatagtttgttcagcctgcacaatgttttaaaaagaacaacaaaaacctacataggatgccaatacttcacattcaggaggtttcccataaaactgcaaagttctggcattttttggaaaaatcagaagacctagctacacaaatccagcattttcctaaggcactgcctttctggcactggaaagcagctatctcccttagaagggtcacaggccctcctgcttgccacagtccccgccccagacacatgtccttcacttacggctgccagtgtggctgctgtgggcattggtgtttgtaatctctggtttagtggatcctaagctaagcccagcactttcagctggaggacctgaggttagagagaaggacgggatatgaaccatagacaggttgtaaagtaacgtggctgcaaagtccaagaataatttaactcaagaagcacctatgaatgcacacccaggaatacaaggcagagagcaaagttgactcccatggataggggtgagagtcctgtcttctcatcagcccctgctacatacttttgacaacttgtcccacttccccaggaccagggactatcttctttgtttttatgcttaatgaagtcctaagactgccacatagaaagcacttggtaaattcttgctgaaccaaaatcaacggaaacccaattcatgttataggtggaatctgagagatgtatgctgagaactcagccaacttctgagctgtaggatgttttcctgactgtaagtcaaggcaagtcctccctataaagaagagtttggggtataaatgacacagcagaaggagacaagctcaacctactgattggctaatgtctgagatgaggaagcagaaaggttagtctttataggatatgtagcatatctgatgagctatggtctgttaggaaggtactatacgtactaatttcataaaattgaagtatgttccaacttatcaaaggatgcaaaaactccacagaaggaaggaaggacctcatgtggtggcaggtgcagcatattttactgcaacctttctaggtctaaaaaggtaaaatgaggtttatcacatctgcttctgctgtgtatagccatggctagttttctccagctctgtttattaagagacagagagaaagaaagagagagtgtatgtgtgtgaatatgcatgtgtgtacacacacatatgtgagcatccacatgcacatacaggtatgcatgtgtggtctctttcattcaacacccccccaaaaaaagttgctatgggatctgtagattttgtttgctgagtatccctaattttggaattccctctgttctaagttgccccattcttggtactaatttcaaatggctgtgggggaggggaggctagcttcagacaagattccactaagagttttacttctgagctgggatagaagcaggaaagaataacaggaaaaacatgcagcatcccatctctgcactttgcatttagttataattattcacgcaggagcatctttaaacaccaaacgagggaaatattacagttgttctgatttcacatgctaactgtgtttacatgctaacagcatttctcagggacaattatcttattactagtgcactaatcttttcaatcttttcaacacattttacagctgcagacttcaaaaattaaggctaattaagaccttgctttcagcaggtacagtaaactactcacattccaacatggtaaaagaaaatcagtttaggggaaagggtgttagaggggcacagtgtcaatggcagacagaatacattagatagcttccatcagtgtgaggactacaactctcccaatgctaatgttcaagaacaagttccattaatggtaaggcctgtcgaattcaggaccaaggacagctggtctggcccatttttaagagaaagtgggtattttgcattcaattatccgtttccattcattatcttcttccgtgtgacttcagcatagaatagtggctaagaacatggaaacttgtatcagagtctctgtgtacaaatgccggctcaattattttccgtttgaacttgagcaaattacttgagatcttggtgcctcagtttcctcatatgcgaagtaggaataataataatgacatatacctacttcccaggcctgttattaggattcaccgaatatctgtaaagcacttacaacaatgtctgatcataataaatcatcaaatacgtatttcttttaaaaagtgtggtctataaggactaacaacaaacatctgttttctaacacgttcttgacctcacatgtactcactgcattatgggccatttgagggctgctaatatataatcatagctatatttattgtgcctgttagcaatacattctccagttacttgccctgctatctcattagctgccatataaaaccagcaccttggatcatccaatattattttttgttttgtttcgttttaaatcacagagaagcagaatgctctctgaagggctgttgttggaatccatattcacagtccagcttctcagatcccaagcaaaagctctggcatcccaagttgtggcgtctgagaaaccagtaatcagcgtctacagtgctcgggccactgacgttcatcaggcacctactatgtgcctcaacctaggcttgagaggctgctttttgaatgctcacaccaactctgtggggaagataatgctggccccattttatagatgaggaaactgaggcttcagacaattctacagccacaaaacttgtgaataaaacaaagttaccgtgtagtacacgtgtttcattctctccagccacacacttttaagccagctggcggaatttctcaagatgatgaatactattatttttactagctgtagaactcataataatggttgttaccatcaacaccaacatacagcatgtgccaggcactgacatattttactcacttaattctgacaactgcccttaaggaatggactcctattagcctctatttacagatgagggacctgggctcagagaggttatgccatgtgcccaaagtcacacagctgcacagtgttggagctagaatttgatcaaattcaggagatccagcttgagaacactgctcgtgaacactattctccagcctctcgtaatacctataaaattcaacaactgtctccttttcaatggacacataaggtatctttaacaagatagctacagggagtattgattccatcatcttatatcaaacaactgattgcaaaattggtgatttagttagatttgtgataaatgctgccaaaggggagaaggtagggacagaaaacacaggaacttcatccaggagagaagatcagaaaggttctttcagaaagggagaattaaactggctgccaaagaatgagtgagaatcaacttgtccaaggtagaggagaggacaagcattttaggcagaaggagaagcatgaataaaggctctgtggtgggaaggcactcataattttgaggacacaaagaaaggaagtctgaatctagaatcaacattgagaaggtgagtagcatatgataaagtggtaggatttggtgtaggggccaccaggtcagggagtccctttgggtgctaggaaggagcttgagtcttatccaaagagcaacagggagtcactgccaaagttcctgtgtagattgattggaatcttcatcaggatcagccttcactcctactccctagattataatatttggcttttacataatcagatccaaaggtacttctgaaaaccaactcagtgaatcagcacactgaagattttcaaaataagtctcaaataattcctattccccatttttagggatcatgatataacccacacggtctaagacattatgttgctactaccatgccgtactaattattcaaccctcagtattgttattacagacagaaaaaaaaaaacaagaggtgatatcttgtaacatgaaagtcaaaaaaaatcttttttctgtctaaaatagaaggacaaaaaaaatcaatctaggttagaaaacatcaatttgcaagagttctatggctgaggaaaatggcatgagtatttgtaggctgaaacaaatgagcagctaaaacatccccccaccacctcccacacataaccaaatgggacagactacttctggcatgtttccatttactcacacctacaatgtgctaggtgctatggtttatttcaaccccataaccagtgtgaccaagcatcccagcttgcctgggactgaggatatgggacgttcagcactaaaaatcaggcatatcccagaccaactaggacacactggtggctcaacctgcaacaaccacagctattaatataaggcagacacaggctcagagaggtggagacacttgttaatgtcacacagcaggtaaggggcagagaccaagattcaagttccagtccgtgcaacttcaaatcctataataacatttcttaggcacttattatggactaggtagtgctttaagcccatttagaagcattataagcattaattaatcctcgcaacatctctatgaagtacatactattctgggtcttgttttatagatggaaaattcaaagctaagattagctaataactcacccaaaatcccccagccaagagggacctggctttagtgcctatattgttaaccggcccatccaacagacccctgggcaaaaaccctgtcgcaatgcaaaaaaaaaaataaaattttagctgtttcttgttcaagataacatttaaaacacacacacacacacacacacagaaaagattagacgagaggtctggaaaaacaagttgctctgagtcttacagccaccacaaagcaggaattgctagtggctgctgatttacaaggctctctggtgaattacagaaagggaaatacagtcagatttgataaggctggtcaagttcggtgctcaagagcagtccatgatccagagaggccgggaacatgctcctgggccctcgtgcccatcagatcaatccccaccggccaggtggatgggtctgctgttgggacaggcagcctggaaccacatttccacgcttcagataaaggtggcttccggagcccggcctttcactaccatgccctgggggcaccacaggcaaagacccagacttgaacggctggagccactggtgtccctacgatgtatgtgcagggggaggtggcagtgttgaaaagggacggtcatcactgcaccaccattaccattagcattaatcactgagtgtgtttgcttgcgtcagagcctgtactgttaataaaccctgacctgtgtatccaaccactttacagagaaggaagtgggactgtggatcacagccagcgttgccctagggcttagaggggcccatcccactgtgctttcacgacctggtggcagtggttctcaaccaggggggtggttttgtcccccagggaacatttgacactgtctagagacacgcttatttgtcataacttgaaagggagcgtgtactggcacctagagggtagagacagggatggcgctccatatcctacaatgcacaggtcagctgatcctttatccagccccaaacatctatagtatggggctgagaaaccccaacctaagaggacagaggtaggccaaccacagccagccaagcttgcaggttgtgtccttccagacccttcctcagggtaccagccactcaaactagaagccagtgctcaagaggatgggtgatgtctcttttgctcacagctgcatctgaagggcctaaaacagatttggtgacttgtcttttctgttaaagaacagggacctggctgggcacagtggctcacgcctataatcccaacactttgagaggccaaggcaggaggatcacttgaggtcaggagttcaagaccggcctgaccaagatggtgaaaccccgtctccactaaaaacacaaatattagctgggcatcatggcttgcacctgtaatcccagctacttagaaagctgaggcaggagaatcgcttgaatccgggaggcggaggttgcagtgagccgagattgtgccattgcattccagcctgagcaacaagagcaaaactctgtctcaaaaaaaaaaaaaaaaaaaaaaaaaatagggaccaaatgacgaatgaacaagaaatgcacccaaccaggccaggtgtggtggctcacacctgtaatcccagcactgtgggaggccaaagcaggcagctcactttaggtcagaagttcgagaccagcctggccaatatggtgaaacaccatttcttctaaaaatacaaaaattagccgggcatggtggcacatgcctgtaatctcagctcctcaggaggctgaggcaggagaattgcttgaacccggaaggtggagggtgcagtgagccaagatcgcaccactgcactccagcctaggtgacagagtgagactctgcctcacacacacacacaaaattaggtactattctgggtcttgtttttatagatggaatagtcaaggctcagattaactaataactcacccaagatcccccagccaggaagaaggacctggttctagtgcctatgttgttaacctgcccatcaaacagacctgttgggacctcatgaggccagacactaaccccctgtcctcagctagacatggcgatagagttcccattgtctggatggcagaatcttcccatcactgcagtggttcaagacatccaggctctttgtttggcgggacagccagcctgctctattctcaggggaagggctttgagaatggcttatttagctcactccccaagaagcttatcaccccaaccccacccctgcccaacaaacacattcccatcaggaaagctggacgaccctgccttccatggaatggaagctatgatcccatccattcagttcagcctctcataaacgctctgttccaaacataaccagaatagtcagggagtcctcgaaacccagacatgacttattttctatttctagcttaaccacgtgatgcctgtgagtttcaagcactggagcatccccattcacgctggaaccatctcatctagaaaggggagggtgtacaagcagctctggatcagcccactggggttcagaacaagcaaaagaatttctttacctcccctgagtttcagcctcaaagagcagcaaagaacctggagcccattaaatccagctgtgctcattgtacaaagggaagaactgaggctttggaggacaaagaagatacccagatgatctgcattgctctttttctcccttgcttctttctctcttgttgaattggaataggtcaaacctgtctacagtactcaaatgtcacgggggtttcctccactaggcatggggcagagcttattctcaataaatgttcgagaatgaaacgtcagcaattaactagcaggcaactttggagaggatttcacttcccctataattaaacacaacaaatggcacgaatgttgaagggacaatatgcatgggtgtgtgtgagaaagaggaagagactgcagttcccataccaaataggtatttatttgttccaagacttttttttttcaccaaaaaatgctttaatataatcaccttttaaataatatacactgtcatcttgattatgtctattgggcttactcaaagaggccaggaccttgcagagaaatgagcctgaggtttccttctgccaggtcaccagtcaatggatatttcccaaaaggtggatcttttaatatatgactgcataatttaacctaaaatcctagttagtattctagcaagatgtctccttctaattgaggtaatttctaggaatatgttgctaaaagtttccttttcttcaaataaagcaataactgccatttatgaagcacgtattaggtgccaggtacttcactggccttaactctttgtaactcatgttttcaccgtcacgacaacactgtaaggcaaattacgaccagttcacagccaggaaaactgagactgaggcagaaaagtaactggcccagtgctgcagaaccagtaagaggctgagctggggttagaacctaggaatgactctcaagtccaagctctttatactgtattctcctaagctcagattaaaacccactccatcccctactttcttagtatttcttcatagacagaatatttcaaggaatttaacttttaccacaagggatacaaaacaaggaatgagaggacctgtcttacctccgctttatcacaaccactttgcaaagttactgagattcaacagctttgtctgctaaatgggcacatagcccttcaaccactcctttgctttgctgccagaaacaaaggaaaaggcaggaaaaaagtgcatatttcttccagaattgtcagaggccagcagatcttcctgcaggatgtcagcctaagcaatctttcaaatgctccccgggcaggcagcccaacccaccacactccgctccaaggagacacctcctaaaataaaccctgctaacttcagttagctcaccctaaagactatatatagaagaaaagactcaggagttcccatttggcagcagcttctccaaaactcagcgcaaatggctgatttctaacttaatctccaacatctgacaggcggctttaaatcagggaggccgactaagagatggaaaacctctgtgaggccagcccagcctgcctgggggcagagacaccccagggcttttcagcaaactggaatggcatgaaaatgggaacctggcccccggaggatgcgggagagaaattagacaaggtgtggtgggtgggagcaggatccagcccagccaggccactgggcatgttgtgggggtagctgggggtagaggacagtgatctgtacagaggcactgctgtgaattctgaatcttggtgtcttctgggcctcatgttatcctagagaataacagaaagccagggaaagctttgagtctccacatctatgaaatgaaggatatctctctctctctctctctctctctctctctctctcacacacacacacacacacacacacacacaccccttacctccagagagccagacattcactctcaagacacttttgaaaatactggtctttccaaagaccatcatttgtatttgtatttgaaagattgcttaggctgaattctgtaggaagacctgctggcctctgatagttctggaagaaatatgcacttttgtctccattttcctttgtgtctggcaacaatgctaagaggtggttggagggctgggagcagtgcctcacacctgtaatcccagcattttgggaggccaaggcaggcggatcacttgaggtcgggagttcgagaccagcctggccaacatggtgaaaccccatctctactaaaaacacaaaaattagctaggcatggtggtgcacacctgtaatcccagctattcgggaggctgaggcagaagaatcacctgaacccaggaggcggaggttgcagtgagctgagatcatgccactgaactccagcctgggcgacagacccagaatctgtctctaaataaataaataaacaaataaataaaaataaaaagaggtggttggagcgagatgtgcccatttagcagacgaagcagttgactctcagtaactctgcaaagtggttgtatatcccatggaaggatatacaagaaattgttagcaatgattcctttaaagacagagactggaaaagaaggagaagtctcctattttatatccttttctcatgggggaattttgttatcacatgcttatactccttatatttaaaaagcaagtgtcattcacagatggagggataataaggtggcttctcaaaaaattaaatatagaaaaactagatgtcaaatgctatataatcagcaattcctcctctgggttcacaacctagtgaaaagaaggggcttgaacagctattggcatatctgtgttcaaagcagcattactcacagtagctaaaaggggaaagctagcctagtgtccctcctggaagatctgcgtggataaaccaaatgcaatacacacataccatggactagtcagccttaaaaaggaaggaaattctgacacattccgtgacagggacaaacctcaaagacattatttatgctaagagaaaccagccagttacaaaaggacaaatactgtgtgattccacttataggaggtacttagcgtagtcaaaatcatagacacagaaagaagaatggcagtttccaggggctgggggtgagagtggacaatgaggggctatactttgttgtcgttgtttctttttttgtttgttttggcctgcaaagcgttttagaacttttcaattaatcgctaatgtttgaaactcagaaaatgtaaacaaatctagagtgagagaaagctcatcagttgtttgcctgtggatggggtttggggaagagggaggtagttattgtaaagagaaataagaaaatcctgggggtgatgttcattatatccaataatttggggtgatgatgtcacaggtggatacagatatcaaaactcatcaaattttacactttgaatatgcataatttatcacaagctaattacatttcaataaagctggacaattttatttatttcatgctattcaaacaaaaaagaaaaaaaagaacaaataaaaggcaacacctttttttttttttttttttttgaaatggagtctcactctgtcacccaagctggattggagcgcagtggcatgatctcggctcactgcaacctctgcctcccagtttcaagcaattctcctgcctcagcctcctgagctgggattacaggcatgcaccaccatgcctggctaatttttgtatttttaatagagacggggtttcactatgttggccaggctggtcttgaactcctgacctcaaatgatccacccacctcagcctcccaaagtgctgggaatacaggtgtgagccactgtgcctggtcgcaatatcttaataaaataaatggagattgaattattaatagaaaatgtctaacattttagttctgacagtctatgaaattgattctaaatccaaggaaacattacagaaggagaaattaagatttctaggaatgaatttatttactcaactaacagtggcaatggatgtgggctaacagtgcacttcaactttatctcagttaatcctcactgcaagcccatgaagcatctgttggtattttccccattgaacagatgacaatactgaggcacagagaggccaccttccagaattgggatgagggcagggatgattccagagtccatgctcttacccactgtgccgtgccccctccctcaattgtcattggacacccactatgtgctgggcactctcttggctagattcacagtgagagaagccactttgggccaaaaggctgcaagaaggggcaaatggagatgccggtatttgggcctctccatctttctggggtggaaagtatcactgcacatcatcacaggtacacggagagctccacggtgggcccatttcagcaagaggcattttaaggtcccaggaattgtccaaggcactgctgccccataaaactttctgtgatgatagaaacagtctctgtactgaccccagtggaactcactagccacacgtggctgcccaccacttgaaatgtggctgttacaaatgtggaattgcatttctaattctatttaagattactgaatttcagtgttaatgggaccccacacagagtggattgcacagtgtcactgtgtcagcagagcacagcctggagatcaaagcacagcacaaaggttggcatctcaggactcggggcaggccagccaagagtgcaaccagcacagcacatgggagatgaacttggccctacagaggagccagtgtaactgcctctgaatgcccccttatctacgtttgagtcaaccaggatactgagggccatgtggaccacaacacacatgctccagataacagtccccatactccagataacggtccccatactggcactcactatcccagacgtctcgtgcaagacactttagtgcattacttcctagagaccgcaagaaggagtaactcccatccccattacccaggtgaggaaactgaggtacagagaaatgaagcaacatactcaaggtcacagtcactggcaaagctgggatttgaacccaggaggtttgactgcagaggacaaatttcaaacaactacccagtcccatctcccaagacagagtcacaccatgccgcctgtcctgagacccacgtactcacttccaacaagctgcaggcagaggctttccttttggtgggaggagaaaagccaggcttcccatggagagagtgagaaagacacagtcacaatcccaagcacagggacagaccgttccttctaaaccaccgtcactagccacaaacacaggaaatgcacagcagcttcacatcttcctcctcattttgcacggcccattctctctgccaggaatcccttcttctcttgcccacctggaggattcatatttatccttcccaattcaagacgttttattggaaacctttcctgacctccgaagataagtagaccactccctcctcagctagctggttgcggtcactgccaccacgactctatcctgtaattacttctctctaagcacccatcttcctcactccactgtaacattcaagattccttgtggcaggggctgggtcttatccacttgttttcccagagccaaacagggtgtctgacatacggtcctggctcggcaactgttgacttgcaatggcaatgataagatgaatgatttcaacaaaaggaacatttacattttaagagctgaatcaagaactcgcttatgtcaaagaaagagactagtgagtatccctcaatgtcttgggcactggaaacaggccagggtgtgttttccaactcagctactttctataatagctgtgtgacccaaagtggaattttcttttttttttttgagacggagtttcactcttgttgcccaggccagagtgcaatggcaagatctcgactcactgtaacctctgcctcccaagttcaagtgattctcctgtctcagcctctcgagtagctgggattataggtgcccgccaccacgcctggctaatttttgtatttttagtagagacagggtttcgccatgtgggccaggctggtctcgccctcctgacctcaggtgatctgcctgcctccacctcccaaagtgctgggattataggcatgagccaccgcgccggcccctaagtgaagttttaacctcttaaagctttccggtttccctccataagatgaggataacattaggatcggcctctgggggttgctgggaggatcacctgggctaataatgtatgtaaaacacttggcatagaacctgggcttctataaagcagttccagccctgggcccaaaggatcagaatgaaagcaaatgagcaggtaggagttgatgctgtacaaccaatcccaggtaagtaggtggttttgccaatttcttctcctttagtcccaccaagttctgagagaccctgggcccattctgtctctcggctggccagacccggttttcaggggccctcagaaaagaggtcacccactgatcacctccctagctgaatctgactcttatatattttgttttgaactgcaaagtgtttttaaatttttcaattagccgccaatgttcaaagctcaggaagactgtgcattcaaattctggatgtctaaccttctttgaaaaattagatttggcctcactgggttcatactttgaattgactgaatctgagaggcactgtctacttcagatgtggtgtgggagtgcccagtccccatgtggccaggacacttgttctcactaccaaccctgcccagaaaacatctaactttgcaactcctgccctagggaaggaagttggccagaaataggctgttttatttagcaaagctattagctaaaagcagggagcagctccgagggtgagtaaaaatccgcattccaaactcatctgacttctctttgacagcaccggtatgtaaagatacagatgaattaatcattccgtttagtaataaactaaccctgttgttgctgcctctgtcatggagaaagcaaaaaatcaatcgctggtggaagcacttctcaatctacacctgacagaggggcgacagttagtgctgtcctattcccagcatcgggcctggaggaattcctgattttaggtgactgcagagtccttgaaggaggtaaaagctgctcacagcctgacagttctctgcatttactcccaaagaggagatgacggagcagagagacatgatccgatgaagagacaaacctgtccatgtcactcacctttatgtcttattggaagtgtcacctcttcgtagatgtgacaactgaacctagtaaatagaggcccccgctgcctgccccatccccataacacacataaacacacatacacacacacacacacacacacacacacacacacacacacacctatgtactccactgttggcctccctggaacatctgccagaggctgtaatatcttatttgttctcttgtgtgctcttttcagctatattatatgctgtacgaagaaagtagccttgtctgatttgatctgtttccagctacttgtctgtttctggcacctcacatagcccttggcacccaacgagcccttcctgaaaatttgcaaatgcatttttgacacaatacacggtattctgtaacgtttccaaacttccaatgcccatgcactagtttcacggtttttgccatatttctgtaccacccagtccagtaactcagtattttcttcaaccaactctcatcttgtagtgaaatagatctctttttaaaataaagctttacggccatgcatttggtcaatagagagacacctgtaattgatgagctctggagttgacagtcacctatgagcagtgtgaccctggacaagtgagttaacaacagtctatgaaattgattctaaatccaaggaaacactacagaaggagaaattaagatttctaggaatgaatttatttactcaactaacagtggcaatagatgtgggctaactgcacttcatctgcaaaacagcactaacaatagcacctactgaatacagaggtggttcaagggtaaatgacttaaaacatgtaaagttaatttacggcaagtgcttccaatagtgcctgccacagagccaacacgatatgaatactgcttgtattggtattatttaggggggaaaaccggtatcgctttaaataaatacatgacaattaaaaaaatcacttatgtaacagctgagaaacacttttggagacatgggctaagcctgagttttactgctacccaaatgtgaaaagcacccccttcgccaggtcctcatctcccatcttttaaatgaagatgttgggccgggcactctaagattccatccatcttccagttctgaatctctgactctcagtcatggataacactaccttaaaagaaataaaataggaaaaacctgaatttacacaataagctcaaaaggaaagagctggaggcggggaggttattcacattcccaaaggatttgcttttacaaagggattaacagcagagttgctttaaatagcagcttaagccttgtttatggattactagatacttgatggagaggtggaggggctcaggaacttggaacaaaagctttactacacccaggcagaaatgaaaaagcgcatatgttttctttaaaattacaatacacatcaacaggagaaatgattccatttcaaggaagctgattcctactcagtatttccgttgcatgtcaattgcatccaagaagatatgcctgtatccacgagccagtttagagcagtaatccagtgttcatatttttaagcccctattataagagcactgataatttattaaatgtcccaggcactgttgagcatatgacatgcattacctcatctaatcttcacagtaacccaataaggcaggtgtagttgtcatcatccttttacagatgaagaaactgaggctaagagaggggaagtgactcacccatgtcaaaagatggcaaatttaatagtcaagccaaagcgcatgaacctggctctgaggttagattataaaaggtaagatccttgtctcaaagagggcacagaacagccacggaggtcaacagactcagaggaggatgataaatgccccaagagacacctttgagggagcagaagaagaggatatcaaggtctagggtgtgcccaaagccaggagtgacctcatctgacccccaggtgtccatattcgagcatctctaaacactcagtgtatggattcctctcctccatccttcatgcatagaccctcttatctgtacctccctatgcacaaaccaatgtgtcctaggccactctattcccgaaaggtgggctgtgggactggaggcaaagagagaaagaacaactgttgcagggtctctgccagcacccacactgcttcactagactacctgagagcttcccattgcctggttttcctcctttgaaaaatggggatattcgccaccccccacctccctcagcagggaagcactagtgattaattaggtaacatctgtgaagcactcccagctttccggagaagggcaccttgggagaggagctataaaaacctgaggcacaggctattatcagcgtgatcattattatcatcattgtcattatgacattctcctgcccaaagacctgcagtggctcaccactgcccagagaagaaggtgccattggctgcctggcaggcaagggaaccgctgctaccccctccctggactctcccacccccatgcatctctaaccaataataccctatatgtgagtcctgcaacttccacatggaaccccttctcctcagagcagctccagtcttgcccggtccaagaacctttcctaaccacgtaggctggaagctcaacattggcatgcctatttctgctgtagacaccaagatttttctcctcgtgaagattctattcagaggaatacacaagtgcataaaaaacagtgatattgcatgagtttctcttttcccagagctataaaacaaagatgctacacaaaccatgactcagtatcttagactgatgctcgtgacttataatgggttagatccaataaacccaccgtaagctgaaaatagcctaagttgaaaatgcatttaacgcacctaacctaccgaatatcacagcttagccaaccctgccttaaacatgctcagaacactgacattagcctacaattaggcaaaatcatctaatacgaagcctagtttataatgaagtgttgaatactgtacatggacattttgcagacatgacaggatgctaaaacacaaaacacactatccaaatacatcgctagcctgagaaaagatcaaaactcaaaattcgaagtaaggcttctgctgaagatacatcgctttgcaccaacgtaaagttgtaagtcaaacccactgtgagtgactgtctgtgtctctgattagatgataagcatgtagaggaccagagagagttcagataaagtctacaattcatgaacagggcctcaggaactagttaagggaacaagcacggtctctgggttcagacagaccagagctccccattctgcctgtcaccacctccctgagccccaacttcttcctctgcaaaatggagaccagcatacttaatatgaacagttaaagaaaaaactaatccggattaagtaaggagaaacatcattggaaaggattattgcgaagggcagaaaggaaaaatcacactacggagggtgctttaccataagatcttaaggatcctgaagcatctcaaaggctaggcaaaaaggagttttcttttaacaaaaaggagaaacaaaagcaggtttggggaagaaaggatggtatgatcagagagtagatcagagaatgttttaccctgatgccagccttttctcaggaggggctgtgtgctggctcacgctcagtgtgggtcaaggcaaaagcacctggaggaagaagagagtctgatccaaagtctggtgatcaagcatgttgttctgattgatcagtgggaatgagcagccagctcatcctttataaggtaacaaatgggaatatgcagggtctgggtctagccctgtcctggggaaacaaaagggtatccacgagttgtagctaagtcacgtgggcaacactggttctttgcagcgaggcattttctgcaacacaaacaggtgagtggattcctttaacctttgttcttttgcaggagcacagggctcaagtaaaattcagcattgttgatccccaagaaagtggctgtgtagattcaatgtgccaatgcatagaaagcctttaacaaattgagtttttatcatttttatttttcttagagatagggtttcaccctgccactcaggctggagtgcagcggcacgatcctggctcacttcagcctcaacctcccgggctcaagtgatcctcccacctcagcctcctgagtagcgaggactacaggtacacgccaccacacctcgctactatttttgtttaattatggtttatctgcaggatagtatagaacaatcattgtaagaggcagaaggttgagaaaggagtacagacattctggaggtgtcttgcaaataaatatgcagccccggagtggatctgtttagccagccaggcatagaacacttctgactcacactggactttctgtctgatcagccccaggccatttttacatcatcttctcttaagcaagacaggtcttcagcctaaaacacatccaacatagtccctggcgattgagaagttcaaagaaaaataaagtgaaatatacagcccaccactgcaatccatccaagaatcaaagggtgtaggcttcaagacaggatggagaaccaggagttaaacaaaattctccactaactttttatcctctgctataatcagtggcatgcaaacctgttttaaatttaccgacagcttaagctgccacccaggtcttgaggtatttttagtcaactagaaattcatttagagcctgaagtcagggaagggaatcgtgtcaggtgtggctcctgcaggattcaggtcgtgccctgtacctgctttagttaccactcctcatttgcacacaattaaataatcacttcaccccctgcccatctcttcagcatcttcagcatctcctcacaaagcagcaggagaggggaataaaacgtcagggaagtcaactctaggtttaagagatctgttcttaatccgaacatcatttccattagcagaaacaaactcaacagggggaggcgagtacaaggaatatagggccctgagccgaaccaaaagagaacaaattcctctttccccactcaaaacaggcctatccaataaagttgcggctgtatgtacgtgaataagctgccagcaagaacgaggcagacacaggaggaatgaaattaatacttcggggtggggagtggtaagaaggtgcctaagtcgaaagcaaaaccacccaccctagtgtacaagccaagcatggaggaggcaccttcaatgcctctttatccttcaggcccctgtggccaacacatctccaattcactggtaagtcaacagagtctgtccagaacttgaaactgcctttgcaaaaacggtaacagtgagaaaattatgacagtgaaagaggtctgatctaaccaacccccatcttgcctttacctccaaaccgctcatgatcattcctgggcttgggtcaagctaactttcagagacatttagtttatactttaaaagataacagtccttccccaaaactaaaccacctttgtaaagctaatgtaggtccattaggttacaaggattaaaaggagccttggccaggggcagtggctcacgcctgtaatcccaacactttgggagcctgagattggtggattgcctgagctcaagagttcaaaaccagcctgggcaacatgacgaaactcccgtctctactaaaaatacaaaaaattagctaggcatggtggtgcgtgactgtaatcccagctactccagaggctgaggcaggagaatcgcttgaacctgggagatagaggttgcagtgagacaagatcaccccattgcactccagcatgggcgacagagcgagactccttctcaaaagaaaaaaaacaaaaacaaacaaacaaaaaacctgaattctgctagtgtaaaggattcccagccattattcctgaggtcacaagatttgcaacttccctgattcctcctgcagataacatcactcctgtagaacctaagattggccttttgagatgtcttttcaggtttttgcatttcttttatttaacacttgatatgaactaggggaagatttttacatttctgactatgatggcttgacccagacccaccaaccagtactgtgtcctcaccagaagaggaccattttccacccacccctgtgattgcatccccaaccaaccagcagcacccataactttgtccgccaaactatccttgaaaaacactagcctcaaaatttccagagagactgatttgaatcataaaactccagtctcccattcagccagttctgcatgaattaaactctctctattgcaattcccctgttttgataaaatcagccctatctggacagtgagcaaaataaacccactgggcaattacaaactgtccacttctgaccttgaccaccactatgctaacccaagtcccagtcatcttggatcccaacatccctttactcccagggtcctttcttcttccagcagccatcagaggcattgatagggcttggctgtgtccccacccaaaactcatcttgaattgtagctcccataattcccacatgtggtgggagggacccagtgagaaataactgagtcatgggggtagtttccccccatactgttctcatggtagtaagtctcacgagatctgatggttttataaggggtggttccccctttcacttggctcttattctctgttgcctgcctctacgtaagatgggcctttgctcctcatttgccttccgtcatgactgcaaggcctccacagccatgtggaacgttgagtcagttaaacctctttcatttataaattacccagtctcaatgtctttatttcgcagcatgagaaatgactaatacaggcacccttataaaatcataaaccaaagaacatacaacatagcaatttgtaaatcctacatgacttccccatctccctggaaataaaatctaaacttctctccttgatcataaagccctataggatcttacccctgcctgttcctcaagctcatctgacaccatgcttccttcttcctctgtgctccagcaccgatggccaaaggtttctagaacattccattctctctgccgcctcaaggccatttccctctgcctgggaggtttttcatccaagttttcacatggcttcctggtcgttgaggtctagggccaaatgtcacctccctcagggctctcttgggaccaccctcttcaacacatcctcctattttaatcccatgtataatatttgccatgttaacaggttctactttttttggtctgtttgatctctgtgtgttattcactgctgcatcctcatcgtgcacactagctgatactcctaaaaaatatttattgaatgaataaacgaccatcggaaggagaaaggaaaccccttctctctcaggaccccaaattcactatgccaaatgggagagttatgcttggaaactgagtcatgcaaaacactgcctttccctttgttcctaaacagacagctgcaagacagaaggccacatatctctccaggtggcctccctcgccttgacaatgtaaattaacagcttatcttcagaggtatgggacaaagacaagactagaaatcatcccccactgcccaccctaagacaaatgtatatttgacgtttccctccactttatgtttactttatcccatgtaaaatacagatttactgagcttgagacaaatatataagtgactgttcccctaccccctcctttcaaatgcaagatgtgggttcggtaagagttaattaaagcctcataagaatgtgacctctcacctcactccctaccttccctcttttctttccttcctccttcccctcctgcccactttttcccctttaaatacagagtcctcaaagccctctttggaaaaagcacaggccagatcctccagcgactttcatccctttttcctggggatgtcctcaaccttggcaaaagaaacctctaaactgattgaggcctgtggcagacactttggtttgcagaagaaaccacaactgtagcacatgatgtgagcaggtggatctgaaggtgatggtgtgtattttacatgacggcatacctcaatgtgtttattttttatttctataaatgtaaggggtgcaggagcaattctgttacatggataaactgtggagtggtgaagtgtgggcttttagtgtataccatcatccaaacggtgtacattatacccatgaagtaattctcatcatcccccccaaccaccctcccactcttcacagtctctagtatctatctcattccacactcaatgcctgtgtgtacacatatttagctcccactcccactgatgagatcatgctgtcatatctcaatgtagatgctaaatgttcaccagcaatacatgctacatctttagagttcggaaaaatgtcatatgagtctgggtgtggtggctcacatctgtaaccctagtgcttttggaggctaaggtgggaggactgtttaagcccaggagttcaagaccagcctgggaaacatagggagaccccatctcaaaagaattaattaattaattattattattattattattattttttgagatggagccttgctctgtcgcccaggctagagtgcagtggcgccatcttggctcactgcaagctccgcctcctgggttcacaccattctcctgcctcagcctcccgagtagctcggactacaggcgcccgccaccgcacctggctaattttttctatttttagtagagacggagtttcaccgtgttagccaggatggtctcgatctcctgacctcatgatccacccacctcggcctcccaaagtgctggcattacaggcatgagccaccacgcccggccaattgatttttttttaaatgtcaaatgaagtaaattctcagacccaagtagttccaaatatatttaataactgaatcaggtatcaggttttaaattaatgaaaatgaaataaaagtaaaacttcaatttctcactgctctagccacatttccagggctcctgatatagccccatgtggctgctggccacctcactggacggtacaggggtggctcatgtcacccaccacagcagcgatcaccgttgcagttcacggagaacagatttctactctgccttcatggaggtatcttctccatgggaggcagcggtggtctccacacgatccaccaagtccaaccctgccagctttttcattctgctctctcagagaagctgatatggcccagtgattccaatagggagcatctgggcagagtgccctggaggcagcagtccatcctcactgacatacagcacaactttacccactgtgcaagaagcacctgagcttccatgtcagaccatggaggaggacagcatttctggagataaataaagccaccacgcttagagaaaacaacagaggagggtgggaagagctctggccctggagctagaccgcctgggtttgaatcccagcagtgctactgaccagctatgtgaccttgggcacacaatttaacttctctatgactcagtttacctataggcaaaaggtcagcacctaccccttagaggagttgaaaaggacaaatgaaacagagtatataaagcatttgttgggctgggcatggtagctcatgcctgtaatctcaacactttgggaggccaaggcaggaagatcgcttgaggacaggagttcaacaccagcctgagcaagagagtgagatccctgcccatcccccctgtattagtccattttcacactgctatcaagaactacctgaggctgggtaatttataaagaaaagaggtttaactcactcacagttccacatgggctggggaggcctcaggaaacttacaatcgtggcagaagaggaagaggggcaaggcacatcttatacggcagcaggagagaatgagagtgaagggggaactgccaaacacttttaaagcatcagatctcatgagaactcactcactatcatgagaacagcatggggaaaacctcccccctcatccaatcacctcccaccaagtccctcctttggcacatggagattacaattcgagatgagagctggatggggacacagagccaaatcatatcaacccccacccacaccaatctcttaaatattaaaaaatggaagggtggtgcattcctgtagtcccagctacttgggaggctgaggcagaaagattacttgagcctaagaattcaaggctgcagtgagccatgatcgcaccactgcactccagcctgggcagcacagcgaaaccttatctctaaaaaaataaaaataatcacataaaacaaagcatatgtcacaagtgcctggcacatcacaatgactccctataaataatcataataattattcttgctcattataatactttgagctctgctcacagaagtacagaacaacacaggtgcccctgttaaactgaagccaaacttctaaagcagatcaattaccaggagatcattcacaatataaaggattctcatcggggactcctttaaatacagtgaaatctgtgaagggcttttcaaatcggaatcaatttaccatattgacatggaattcttcagggacccttcggggaaggactcagatgtagtgtcctctctgtcactctcatctgttggttggtgaacagcagactctgttcaccattcctacaatcagccaaggggggctgtgatgtttcacaaggcgccacggcagagagatgaaagttgttatgggtgctgttggattttagggctgctaagagaaccagatgtttaaaagtagccctgtgcaagtccaagccagagctgccaaattctcgacgcatgaaaaacaaaggcgtctggcttgggaaagtttgtcccaggcagactctctgagtctatttagaaagggttacaatgcaacgtttgtatctacacccctcctgtacaggtttgcaaaaccggaaataatgcctgtcactcatgcagtgactcctgggcacaaccttacagccagtccctgtgctgggcatcaaggaaatacagagatgacgtgaaatacctgctgggtgagccatagaagcaaagcgttatttgcttctgagtctgaaagctcagctgggtgaccttgggcatgttgcttaacctttctgtgattcagtcttctcatctgtgaaatggggatagcagcaggaccttccacacaaactcactgtgagaaatgagtaaagataaatgaaggggttggaacagctcctggcacacagtaagtgctcaataaatgtgtttattcttagttgtggtagtagactgctgataaggggctaaattcagggtgttagggtagtacataaaaaagctatctaggctgggcgcggtggctcacgcctataatcccaacactttgggaggccgaggcaggcagatcacttgaggtcaggagtttgagaccagcctggccaaacagtgaaaccctatctctactacaaatacaaaaaattagccgggcgtggtggcaggtacctgtaatcccagctactcgggaatctgaggcaggagaatggcttgaacccaggaggtgcaggttgcagtgagccaagatcaggccactgtactctggcctgggcagagtgggactccacctcagaaaaaaaagtatctaactagagtatcaggaaatgattaccatcccataccatagccagattcagctcgtggcctattttcgcaaataaaattttattggcacacagccacgttcatttgtttacatgttatctctggctgctttccggctgcagaggcacagttcagtagttgccaaggagactgaagggccctcaacatctaaaatacctcttatctgctcctttaagaaaaggctggccaacctctgatccaattcaattcaggagggatgtgatcagggaaggcttcctggagggtgacaacgtaaattttccttggttaatattgactcttgcatttcagagttattgaggaggatgcttggatcggcaggttcgggtaacagaaaggaaataagcattgccatcgacctctatctgaatcaaatcctacagcaggcatcacagaacggtggctcatgggcccagaaacagtctgcaatctaatttgatatgaacctgtggtgcttaaaaaacacccgagacaacattggatggctgggatacatcataataaaccgcctttccggcttctattaaaaactctgacgatctggcaaccctgggcccacccttcccatggagaccccttttgctggggtacctgttctccagatcaccatgagaaccttttcattcccccctttactctatgtctacagcctctgctctgatgctatcaaaggcctctcacacatattcttggttccctgccaacccaggcagacaaggcaagctgagaaaactaaagttcagagaggtcaagtgactttcctagggatagccatctggtgaatgataaagctggaccggaacctgagcctttgagtctagctcactgtccctcttcagacatacaaacagcggaatgagtcattgctacgattttactagggcactccatagtttgaatagctctttttttttttttttttttttgagacagtgtattgcccaggctggagtgcagtggtgcgatctcggctcactgcaacctctgcctcccgggttcaagcgattctcctgcctcagcctcctgagtagctgggattacaggcatgcaccaccattcccggctaatttttgtattattagtagagacggggtttcaccgtgttggtcaggctggctcaaactgctgatctcgtgaacagctctttcacatatacgagtccagattggaaaatgcagaccttggatccacggaggccacgtaaatattgagtggcatatggtcaccaaaggactgacaaggcaagaggctaaaactccagaaagataaggactagaagtgcatctagtctatctcaggagtcagagtgggcaaatctactgaatccaacaagcactgcttaagtgcctgctggaatcaagacaaagaaagaggcccagctccccatctggggcttagaatgtcacagggagggtgttacctgtaaagtaacaacgtaagaccgactgtgtttctgcaagactaaagggcagagacagctgaaacttcggtggcctacatggcagatttaaggacttactcagggcacaggtggagacgtggatttaagtgagtatgagtgatttttttcggggagtagatgatgggtgaaccatggcccttggatgatgtattcgtttcttgccagctgccataacaaagcaccactaaatggcttaaacaatcaaaatgtattgcctcccatttctggagcctagaaatctaagatcaaggtgttggtagggttggttccttttgaagcctgtgagaaagaatgttccatgcccctctcctggcttctggtggtctgctgggaatcttgaatgttccttcgcttgtagatacatcatgcccctctctgccttcgccttcacaaagtgtcctccctgtgtgcatggctatgtccaaatgtccccgcccccccccactgtttttttgttttgttttgttttgttttgtttttggcagagtcttgctctgtcacccaggctggagtgcagtggctcgatctcggctcattgcaacctctacctcccaggttcaggtgattctcctgcctcagcctcctgagtagctgggattacaggtgcatgccgccacacctggctaattaaaatgccccctttttataaggacaccagtcatattagcttagggacccccccgcttctagtatgactgcatctttgcaaattacatctgcaatgaccgtctttccaaacaaggtcaacttccaatgtactggaaatcgggacttcaacatatgaatctgggggcaggagaggggacataattcaacccataacagatgacatcctcaaagtcactgggaagcatggcaacggaggctgagatgctcaaggccatcctcgaggctcctccccacaaagggtaaagacctgggttctccctggcctttctgggcagaatgagagtccccagaggttctggtgctgttggaaggatcctaagcatcaagggaaggggtgtggacaactccaggcctccagcactgagagcaggagggaagccctgctccctcctcattacactgtggaaaacagaaaactcaatttatttaagaataaacaggctttaacctgaagttcattctcccgctccatgatgctttagcatctacatgcaaccgcagctgccagcatcatgccccggttgcacagtccgaaggacctatattggaaaaataatggcattttctcaacaaattatctcacagctgaagtaataacttgtttaaagatacgccaattcagattttcatccccttaacctgccactaaaagaaaagcggtgtcatccccatggcaaaacaggagcagtttaatcacttctgcacccctgtcctccggccctcgcccccaactccagcccccaccaccacccacagctgcacgtttattaattttaagccattgacagagtctctttggaaaccatgtttttttacttctcaggtcaacatcctccagctctgttataataaagtacacactgccagagataaagcaaatatttctttgggaaaggaaaacaaaatagagtggctgtgttttcaacacaatcgctaaggatccagccagcggacttcttctccaacagcagccatcaggctaactggccctcaccaggcttctcatttatttggcaacaaggaaatcacagcttcaaactctctcctggcaacagcagctttctcagtcttcggccaggtagacaggaaggacaggggctgacagtgaaaggaatgctgggagacacatcaagcattcaatcaacaaacagtgggtgcagctgaccctgtgcctggcactatgctagattctaggtacctcagtgactaacacaaattatagtacctactgtccccaaagaacttgcagtttaggggctgggcgccatggctcacacctgtaatcccagcactttgggaggccaaggtgggcagattatttgaggtcaggagtttgagaccagctagccaacatggtaaaaccctgtctctactaaaaatacaaaaattagctgggagtggtggcacgcgcctgtaatcccagctacttaggaggctgaggcatgagaatcacttgaacctgggaggcggaggttacagtgagctgagatcatgccatcacactccagcctgggtgacagaaagagactccatctcaaaaaaaaagaaagagagggagggagggagggaggaagggaggaaggaaggaaggaaggaaggaaggaaggaaggaaggaaggaaggaactaactaacttgcagtttaggaggagacacaggcaatgaatcaacccatcaaccttcaaagtcagcttgtaatgaaagccacgagtgaaagaaacaaggtgtggagttagagcgaggaaggccagccggaggaggggacacctgatctgaagtttgaaggacaaacgggaatcaaccctatattgggaaagtagtaaccctatactgggaagaggaaaaaaggggaagaaaaacagaagtaacagccagggggatgacataatccagctctctctcctctgtctctctgtctcactctctctttcatacacacacacacacacacacacacacacacctgtctacaatctattcttcagagtcaattctttaacattagtgtttgacaaaatgcaactctccctggaatgaattccaatcagccccagctcagtgtggatgagttttttcagagatcatggctggaaagcttgcaagggagatgatagcacatagggacactgggcccttgggctggaggatgttacaaaggaaaagggacgaggaagcaagggaaacggacttcagatcaatttccaaaacttccaccattctgccttgaggttgctgggaatggagccacccggggtgggagagtcttccagaaaagccagacggacttcctgcaagttcaatctctgcctaaatttatacagagagatatacttatgggcacatatttagcatttgcaagctgaagttgtggaaatggcacaagaactggccagggcaactttgagcttaccgatgtaactatgtgtagtgttctgcaactgagttttttgaggaaagggatggcttcttcaacatccttttctatgttcccgggcaggtaatttaacctctctttgtctctgttcctatatctgtaaaatgggaataacatcatccccacctcaaggagctgggaggggtaaattttaaaatgtatgctaagcactcagataatgcctggcctagttgttcaatgaagggttagtggctatggttattattattattattattattattatatcaacttccacaacatttaggagcactaaacatttatggaatgtttcttggccagtcagctcctgcttaaaaaattattacagaaataattagaaaataaaataaaagccataggcccaaagatatttacaacattatttatttagaatatcaacaaaaatctaaatgttcaacaattgagcaatggtgacattaaataaggtgcatcaacgcagtggtgaattatgcgctaattagcaggatcagcagagagatgacagaaaagctttaaaagtgtttctaggctgagcgtggtggctcacgcctgtaatcccaacacttcgggaggctgaggcaggtgaatagcttgagcccaggagttggagaccagcctggacaacatagcaaagccctgtttctacaaaaaaaaaaaacacacacacacacacacaaaaagttagccaggcatggtggtgcacacctgtagtcccagccaaccaggagactgaggcacaagggtcccttgagccggtgaggtcaaggctgcagtgagccgtcattgccccactgtactccagcctgggcaacggagaccttgtctcaaaaacaaaaacaaaaaaaaaagggtttacaaagcactattaagtgaatatgaaaaagacgaagtgtacacagtttaaaacaatgggtataaatacagaaagaaactgaagatgtgaaaattgcagttgggttggaatggtgggttatggataatgttttttaaaagatagtttacaacatgagaaaatacaaaataaactgcttgtggaaaaaataggattcaaacctatgaggggtttatttgggggctgttggagcatacagttcctcctttaagacatggacaaaaagaagctctctctcttgtctccatggcaaacacctaaatggaaggtgaaaatgcccatcattaagctctcttgatattgagcttgtcttattctacatacatgggtgtttgttttactatatccttttttttcttttctttttttttttttttaagagatagggtcttactctatcacccaggctggagtgcagtggcatgatcacagctcactgaaacctcaacctcctgggctcaagcaatcctgcttcagcttcctggaaagctggaactacaggcaacttccaccacacttggctattttaaaaattttttgtagagacagggtctcactctgttgcccaggatggatataccctattttctgatgaattaatagataaatgaatcacaaaatattcaccaggtgcttatgacatcaaaggcctgtgcggaatgaccatcatcccagcttccagagtgaggacctcaaatatgaagacgatacacagagacaaacaagtaactgatggtaataagccagccacagctaacacttaccaatgcttcctgcaggccagggatcactctatggattttatgggaatacctccctttaatcctcatatccagccttggatgcagctatagccatttgacagatgaggagacacactcacaaagggcaggcgtcttgcccaagtcatacaaccagtaagcggcaaaacctggctttgaacctacaaatcttctgccagggccggcgattttaacacctggattagtctgttttcacgctgctgataaagacataccagagactgggtaatttatcaagaaaaaaaggtttaatggactcacagttccaggtggctggcgaggcctcacaatcacggcagaaggtgaaagtcacgtcttacatggcaacaaacaagagagaatgagagagcttgtgtagggaaactcccctttataaaactatcagatctcatgagagtcactcactatcacaaaaacagcaccagaaagacctgcccccatgattcaataacctcccaccgggtccctcccacaacacgtgggggaatcatggcagctacaattcaagaagagacttgggtgtgaacatagccaaactgtatcactactctactgcagaagaagagccatgaaagctgttcacagcaggagaggcaaaaggccctttcctcaaagcccatctgggaatacctcacccttgtctcttctccagacacaattctccattgagagccgtcctccaagacctcaggttcataagggctagaagagcagcttgaaacgctggacttgccctttggagccagaggtcaggccaggtgggagccatccactagcaggttagagacaacgagattctctctgtgcagttcagaccacagccacagagaattatttaaacccctcctgggaaaccgcagcaacgtcagacagattcaatgtgcataactgtatgtgtgtgtgtctatgtgtggttggggggggggctcagggaggaggtgtgacaagcctgagtgacccaggagggactcagggcccaggaagggtcggatactcctcccccatccaggtgggacacagcgagctgagcagcccctgatgaaaccaaaagagtctcagatcctgtcccttttcctcctcagaactcagagcactggatcctttgttcagaaagcaagagaaaacaccaacacaattcctgctacagctgaggatgagggcgtggagcaggtcacacagacatactagcaagcctgcaaagtcaaaaccgtaacagccacagtaactgacacacgtcaacaactgacctggagccagatgttgccccatttaacctccaagactctcctgtgaggtgagaaccatgatcatccccattatacaggtgagaaaaccaaggctgatgggaattcatcacatggtgcataggaagcaaagccatgtttcgaatccaggaagcctctctgtcttaggaagacacgcacccactcatgcatgcaacaacagatgcacaagtaacagtcagagttggccaggcacaggggcagttgcctgtaattccaacaactcgggaggctgaggcgggaggacgacttgaggtcagcagttcaagaccagtttgggcatatattgagaccctgtctctaaaaaataaaaatttaaaaagaaaaacattcagagttgtgtacattcacaaaaggcatgcaaacatagcatagggatagaaatacaggcataaacgtgtgcagagagctgcaaccacgcgcatctgcccctcttctccaaataagggctgcctctttgcacacctctgagaggtgccctccacacagaatacaacatacacttgtaatattgccacacacaagcacataactttctggagggatgactcagattagaaaaacagcatttagagggcccctggttaatcaaacggcctcgccaccccgcgccacctctctacacagctgatgttgctgatcaatgtcgcggctgtgcagagggggcatttgataccacaaagggagccaactcctgctgaggaatgaatgtggcgcttgtcagctctgccccaggcagcagcacaacatgatgccctgtttctcctggaatcggggccctgcgtccgctccagccctcattttcatgtctttcttcccaacagacacaaggccggctcagttctggagaaacagcgtggctgccaaggcccagtggagggagaaggccttgaaaagtcactttataaagcatccgtgctcgcagcagccaagccacgaggccggagcggctgactttccattcgccacacaccccacccaaagacgagaactctgccacagccagcccttgttctcacccactgggagccctggggagttgaaatcacagggacagcagcagggagcccttggcagcaaacccagctcctggcatcttcctcgggggccgtagcttgctgtggtcagccgagccagtctgatgcaagaactgaatgacgcccattcactgtggtgccctcgtgagctgggagatgtccaggctgaggctggggcaggcaggctctctgtcacctgcagaggctgagacaacctcaaggtaggacgagaacccagggttgaagctagcagaagccaggccctggggcccctgatgcatgatgagagtgaaaagaagggcacagtgatgtaaagaattcctccatttcccctccctgccctcagttacttcctatccatacagaggggggatgaaaactttaagatttcactattcagctgagactggtgactcacgcctgaaatcccagcactttgggaggctgaggtgggtggatcacttgaggtcgggagtttgagaccagcctggccaacatggagaaaccccacttctactaaaaatacaaaaattagccaggcgtggtggtgcatgcctgtaatcccagctatttggaaggctgaggcaggagaatcgcttgaacctgggaggtggaggctgcaatgggctgagattgcaccactgcagcctagcctgggcaacagagtgagactctattttataaaaataagagactccactattcatgcattcacatgctcattcaacaaatattactgagcacctactatatgatgagtgttattgttttaggcactgggagtacattagtcaaataaatagtcaccacctgcatgtagcttgttctcaaaattctcaagctctcccaaccctccccataatgaacagctgtgtgacttagagcacactgcttcccctctctgtgctccagtgaggtctctcccagggttcctgtgaatcaccatctgggatccagtaagctcccccatggggcctaaactagactaagttggtttccgtcactcacagccagaggagtcctgcctaagaaattgggaaagagagcggagaagacaaaaagcaggtttgggaaggctgcagggagctgatgagtcatttgatcatctggaaagcagatgggaagacaagtggagaccaggaggccctggggaagagaagctgtgttcacgccaaccttccccagcaggcctcagaagctgggggtcaaaagggaccacaacgcccatttaaacaaggaggaagatgctgaacagctaaagggttaattcaaaagaaaaaacaaaagaagaaatggccatttcttttccttgttcactcaatgttccttcaacaaattattctatgtgcttggaatatatgaggccctgggttgggtgtggtatgcaacagaaaaataaaacataagaacatagtatgtctcttcccacagggtcatatggtctttcgaaagtcacccttttaatttgaaaccttttgctgcttctttatttttattttttaatttaatttttttgagacagagtcttgctctgtcacccaggctggaatgcagtgacgcaatctcggctcactgcaacctctgcctccggagttcaagcgattctcctgcctcagcctcccaagtagctgggattatagacccctgccaccaccccagctagtttttatatttttaggagagatggggtttcgccatgttggccagcagtcttgaactcctggcctcaggtgatctgcctgcctcggcctcccaaagtgctaggattacaggcaggagccactgcgtccagcctatttattcttattttaaaaatttatatatatgtgtatatatataaggggtataacacagcgttatttttaaggaataagagatattttgcttttcaaagtgcctgctaagcccagtgacatacgcttggttagcaatcactaaatgtggacacattataaatcctctatatattttatagagatggggtcttgctatgttgcccagtatggacatgcgttcctgggctcaactgatcctcctgctcagcctcccatgtgctgggattataggcatgagacagcagcactcagtctctttgtttatttctctgcctgctccccacccatctgtgtgacccctactaaaataaccactgcatggtgttcaaggaagagtatggccttgggattcaggcaggtctgcattctaacccagggccttctaccttctggctatgtgcccctgagcaagtaacttggcctctgctatggcttagatgtgtgtcccctccaaaccgcatgttgaaatttgatccccagtgttggaggtggggtctaatgggaggtgtttgggttttgagggtggatccctcatgaatagatcaataccctccttctattagttctgcaagagctggatgtttacaaacagtctggccttcccctccctctctcttgctttcttgcttacctgtaatatctgcacatgccaactccccttcaccttccactgtgagtgaagctgtcggaggccctcgccagatgcagatgcctaatcttgaacttaccagccatcagaatcacaaaccaaataaactttctttctttataaactacccagcatcagatattcctttatagtaatacaaaatatacgatgatagcctctcagagcctcaatcacctgccctggaaaatgggtacaacaccgagttctttttaaggaataaatgatgttttgcttttcaaagtgcatgctaagtaagtgcagtgacatacgcttggtaagcaatcattgagtgtgaacatattataaattctcatgaaatctaagaggcaaagccctgggaatatcacaatattgatcttctaaagtcagtatcagctttctcatggctcagactcactcctgagttttgtgcttggatacttaacaattgctcactcctaaatttcctaactagttccagcttcaaactggaaaaattcctccagtgtattcaagcctcgttgcctagcaccacaatatccttggttgatgtgcttctaggtgctaaaagaataggccggggatggtggcttaggccgataatcccagcacttttggaggccagggccggcggatcacctgaagtcaggagtttgagaccagcctgaccaacatggagaaaccccatctgtaataaaaatacaaaaattagctgggcgtgctggcacaggcctataatcccaactactcaggaggctgaggcaggagaatcgcttgaacccagaaggctgaggttgcggtgacccaagagatcgcaccattacactccagcccgggcaacaagagtgaaactccatctcaaaaaacaaaacaaaacaaaaaaaaagagtaacgagtgttagatattggtgggggtggcatcagaaggactttgtgtgacattcccaggtctgttctgagcgcaaaggccagatttagacagcgttgagaacccaaatgaggctctagaaactggtccaaacaatgtgcccataatgacacgtgtcaaaaccgaagaaggccttagtcaggggaaaaaagatgcaaattacaaagacctttttcagagccaccaccttctaaaagtgaacagaaggagcaggaagctgccaaagtgtaccagaacctcctccttcgacgctagaaagagtaacaggtcaagctccaacttgcaattcagttctattttgaagtttactggaaagcagaaaataagaagggatttgagagaggccggcagtttgaaggcaaggaggaactgaaataaacacattagacccaagaacacaaaagtcctagcagcttggacctgctatttctcgacagttcctccaggctcctcatgcataagccaatcagcaatgatgtgcatatttcagcaatgatgtgcataatattgatcttgaaccacagcgatcttcctagttccttttgccaggagaaaagatgggggtggccacacatttgagaaagaaagtccattaacattacccaagttggttttgaagtattgagacacttttttttttttttttttttttagatggagtctcactctgttgccaaggctggagtgcagtgacgtgatctcggctcactgcaacctctgcctatcgggttcatgtggttctcctgcttcaacctcccgagtagctgggagtacaggtgcccgccaccacgtccgactaatttttgtatgtttagtagagatggggtttcaccatgttggccatgctggtctcgaactcctgacctcaagtgatccacctgccttgccctcccaaagtgctgggattacaggtgtcagccaccacacccagctgagacacatttttagggtgtgtgtatgaccgagttttatggttgcaaacaaaagactccatgctgcccagttcaggcataaaaagaatgtcctgaataatgcaagatgatgtataggatgcttggacaaccaaagccaaatgtggaggctctgctgtgggtgatcatgtcccaaccacacggacactgaccagcacagaccctgtccctgctgctaatgagttcacactgccaccaccaggcacagacccaaatccttgaccgctgctggctgccccttttgccagaatggattctgtaccaggctagtttccccacataacttgctctttcaggaaatccaaaagtattgatacaaaaggtgtattagagccataagtgcatagagagaaaagcgggtacattaagctttgattctccactgcctgttgtaatagtttgttttcacgttgctgataaagacacatccgagactgggcaatttacaaaaagaggtttattggtctcacagttccatgtggctggagaggcctcacaaccatggcagaagatgaaaagcacatctcacatggcagcagacaagggaagagagagcttgtgcgggaaatttcccttttcaaaaccatcagatctcatgagactcattcactatcacgagaacagcgcaggaaagactcacccccatgattaaatcacctcccactgggttcctcccacgacatatgggaattgtgggagttacaattcaagatgagatctgggtggggacacagccaaaccatatcacctgtcattacttttttttttttttttttttgagatggaatctcactctgcggcccaagctggagtggtgtgatcttggctcactgcaacctctgcctcctaggttcaagcgattatcctgcctcagcctcctgaatagtttggatggcaggcgtatatcagcatgcccggctaattttgtatttttagtagagacagggtttcaccacgttggccaggctggtctcaaactcttgacctcaagccatctgtccacctcagcctcccaaagtgctgggattacaggcgtgagccaccatgcccagcagcctgccattactttcattagcaccaggcttcttgcatattttacagattgctgtcaatggtctaataaacaggtgtgttaacacatccagcagtaaagaaccggggccctcgaacctgcctgcctgggtctgaaccctgctccccagcccttacttgctggaagaccttgggcaaattattcaactcccatctgagaatattattcataacagcacccacctcatgggccagttgtgaaacttacagaagtcaatttaaaccaaggactgaacatagtacttgtaatatgagtttgtacaaaagtatcagttgctattgttgatgttgataataaaagctaaaataacattataacccccttcatggtggtagtttcttcataagctgccattaaagcaaagagctacctacttaatacaatttgctccctaattaattaattatatctaaatttcattgtattgtgtcattctacaaggaatgctgctactatcaccttgggctgctaaaaaaatgcccagtcactaaaaaaaattgcttagacggtattctctgtcatttctcccaacgaataggcagtttattattttttgaagaagtcttttggctgtgacaatggggcctcataacaatgaattgagaacaatcacttccaaacagcagctgaaaacaccccttggttgcctctgagtttgggggtcactgatcaagagggtgacttttctgggacctctgatctcttaatagttgtagttcaacaagagcagttgtggtacattcggcttcaccttcatcgtgggagaatgaccagatgcctacctggttttaaaccacagtcaggggctccggaaactgtccaagaagaaactccggtgccctgaaggcctctgatgagcaacagagttaccttactgactgatggacacagttaattcagctgctaactctcaaattctactgctgactcacaatccggctgcccatcactaggtggcccggaggcctaaggtgaaaaggatgttgtctttctctgggcacattttcagaaagcccatttaaacttcttggtggggcaagagggggcataaaagggggaacaagatcttccacattgcaatattcatgttttaattagcgagtgtccagaacctcatatcaacttgatttgaagggcatgtgtaagaagtatacctacaactccttctctgagccccaaaatggcccccaaaaacgctccgcacagctcctggggttgaagatcctggtgaggtgcagtttgttctcacagccaccgtgcagcccaggtccatgtgcatgattcacacgagaaactaggtgaatagcactcctgggggtgcagaggtatacagggcagaacctggcacacagcaccaggtccacgtgagggggtcctggcgcacacacacgtacacaaacacacacaaaccccacacacataccaaggattccagaattctgggcttaactcagcctagactctaccacattcttcattctgtagttagaggccaaaataaaactcgtgtaaacagattaaataccgtggtaaccaaattcaaaccaaacaccaaggattgggtggggggaggggaaatagtcttactttgaagcatttgggggtgtgggggtggggaagaaaagaggtaaagaggctctaaagattctaagacatcaaagttcttttcctgatttcccagtggaaacaggacagtttcttatactaggtctcccagtggatcaccatccaccatcttggaaggcagcccaactgactgagtcccaaggagacctaacagagatttactttcccaaacaaggaatacttcaataagggtgtatctacagttagagtgcttaattcctttccgagatgttttcctaatggcagcactcctggggagagtcagaagaatgtgtaactggtcaaatcctgaacctgatttgcagtccagcccatgttcacaatgctcgtatctgctgagcctctgacttctgcgaccaatataggccaagtgtgtctggagagataatacatatagccacactccccaccttttcctcaagactagtccagaccacaagctggatgaggtcaaaaactatgtctaatttctcaccattgtatgctcagtgcccaggctggtgcctgacacgcagtaggcagtcagtgaatacagcccaaagagaggtatggccacagtcatcctatttgtgcccccgggacctggtactcaaaaaagaagtaacatatctgatgatggtatacaggcatgcatcaatgccacacactgtgcactgaggggacactgggctggcttcacacccttcaaggactctaagcagtcatgctgggtacccacacatgagcaaggaagggggtgttctgtgtgttttcatagataatgcatttgtctatttgccatccattcatcacatggctaattagttcaactacactttcttattttttgtcatcatttttttttttttttgagacagggtctcactctgtcacccaggctagaatgcagtggtgcgtggtgcaatctcagctcactgcagcctcaacctcttgggttcaatcaacctcagtgttcggagtacctgggactacaggtgctcaccaccatgcctggctaatttttgtattttttgtagagatggggtttcgccatgttgctcaggccggtcttgaactcctgggcttaagccatccacctgccttagcctcccaaagtgctgagatgacagattttctgtattgtagatgctctagcattaggggttttatagacctgggtaaagacatcccctcccagttctagcccgttcttagagatagcaaagggctcaaccaggagcaagcctctcacatgcaaaccaacaaacccagagtctataccccctcagccatcaccatatctaactctcacacaccaagccaattttcccccgccctaaaccaacctggggccaggtagcaggcagctagagacccctctagagcccaaagccctcctgaaattattcaagccggtcaatcccaaactgtttgccctgccttgcctcacctttcctgtgggaaccccagtaaaggttctggcctagattttctccttactcctgtcttctgcctccaaaccaaaaaaccagggcctcctgctgtggccctgcaagcatgctgtgcctcttctttctagggaaactgagtcacactaaactttcaagggcattgacctcactgtgatgtcacccagacatctctatttatttatttggtgggctttatttctatttatttgacctcgctgtgttgtcacccagacacctttatttacttattcatttatttggtgggcttcatttatttgtatttattttttagagacagggtcttgctctatcacccaggccagagtacagtggcacaatcatagctcactacagtctcgacctcctgggctcaagcaatcctccagctttagcctctggagtggctgggaccacaggtgcacaccactatgcctggctatcagacatctttataaattaagacccaggcacaaaacgagacggacccgtggatgagtctccttgtaagcgccttgctttctccgcttcctcccacactccactgggcacccacaggaagccctgacacacataatgagaaatgagcaaaagggcatttctgcaaagggagatgaaaaacaaatcttagaggagtggcgagtgtcctggttaaggctatggagccaggcagcctgggtttgcttgaaggtcacccctgccaccacctcctcactgtgtgtaccagcgcagcccctcaccaccctcaactgccgtttgctcagttatggaacggggaccaggacaacacaagatgctgtgagattaaagcgcatgaatacccaacggggccggcatgtggtgagcactgtgtggacggtaactgcgatgattcctcactctgccttctccaagggaatcagaactgcagaccccccgcagagaaaaacgatcacaccctttattcagcacttcccgcgtgtctgacacacagcacccacagcctggggtataaacaccaaaaaccaccctcacaggggcggaatgatgttcattcccattttgcagaagggaaaactgaggttcagagaggttaagcaggtttcccccaaaacacaaagctggaattggtgcgtgcagccaggatttctgactccaaaaactctcctctcctctccctactttcaatctcccccatttctgatcccctcccctccactgcaacacatatatattgagtgcctactgtatgcgaagagctggtgcaggagttgagaacacagcagtgagcaacactgctggaatccgagtctttatgaatcctacaggcagcaggaaagaggtcattgaggggtaatctcagaaataaatggaggccgggcgcggtggctcacgcctgtaatcccaccactttgggaggccgaggcgggcggattgcctaagctcaggagttcaagaccaccctgggcaacatggtgaaaccccatctccactaaaaaatacaaaaaattagctgggtgtggtggcacgtgactgtagtcccagctactcaggaggctgtggcaggagaaccgcttgagtccgggaggcagaggttgcagtgagctgagatagcaccattgcactccagcttgggctacagagtgagactctgtctcaaaaaaaggaaaaaaaaacccacagaaataaatggagagttcagatggggatgagagctatggaggaaaaggagaagctgctgtggtgagcaggaatacgagattccatttgctgtgcatgcagtgtgtcagacacacgggaagtgttgaataaagggtgtaatcatggaatcaaatggatccctgatcatggatcaagaatcacagacagcttctatggggaagaacattctggaaggaacagcaagcatgaaggtccccaaatgggacaggactggatatgtttgaggaactaccagaaagtcagtatggcagtgacacagtgacaagagaaaagcaggcaatgagaggagagcagaggtcctaccaagctcggccctcccgacaatttgggttggatcactgtttgctgtggcgctgtcctgcactctgtagaataagatgtttagtggcacccctggtctgtacccactaaatgcctatacagctcccgccctgtcctgccaaccaaaaatgtctccagacattgccagataatgcaccccacatcccttccgggataaactgtgagactccacggcgatgctatttcagggacaaaaagaagcctgtgcttatggaacagaaactggccttgccacgacctcattagtggagaggatgggccccactcatttgggggaattatttggggaaaagtataaactccctagctcagcagactgcgagctccccatgaaaggccatgtgtcctggttcctcacacggggcctgagatgcgaaagcacagagggtacctgggagggactgagaaaggaggggactgtggggtccagtgggcacatccctatcacaatcagcctgtgcagctaggaggctgccacgcacatcggcagactctggctttcaaaatgaccctggaggagctgcggctcctgctggcatgtcaatgtcaacagcctttaccctccccagctcctggaatgctagaatttagattctcagttctgcgggagagcaggacagatttacggaattctcagcggctgcctccaccaggggttgccaggggcaagcatctgcaccgtggtgaaacatctctttgaacaaggaagtgagagtgagcatgtgcattaactatcggagatgtgggggagaggaggaagccatgcaaatgagcacggacagccagcagagacgtttaaccttggtgctgctagagtacccacaagtgctaacgaggtggctggtgttgctttaataatcaaataataaccaggcaatggtttagatccattttggacccttcacaattcccaggactacacttaacagtttggtaagactttatggatagcttgcaagtttgaaggcgtaactttgtaagctcagttttgaccctggaggaaggaggtcatgagtaagatagggacaccaaaaagaagtcaggtggtatgctttttccattgactcacagtcatttccaggagaaaagaaaacatcactgtgcaaggctctactgactctcttaatttatcctcacaacagcctcgtatagtaaatattatcctattttacatgggagaaaaatgaagtttagaagcttgggaaatctggtcttcattatttggctactaacccttagtttccatcacaattccctcattctctcagctctagtctagtctggatccttttgcagtcctgccccaggaccttggcacaggttgtttcctgtgcctggattactctgacctcccttcttcacctggttaacgcgacttaaccttcccattcctgcttgctcatctcccagagcctcctctgggctttttccaggccaaactactctaacaaaagctctcttagcatcaagactgctgcttctgcatcaggactcttcaaagttacaatttaacaaagaagccggcgtgtgctagttcaccaccgtaggcatatgcgtcagattcaagatggcttcaaattctttgacatgcctttatcgaaaggtagtgtcttattcccctcctcttgaagccaagatggccttactgactcagctgaccaattgaatgcagtgaaagtgatgttctgggaattctaagcctcaatgataacatacatacctttgcagctcctgctggacctcttagaatatttactctggggaaactccctcttggaacccagccaccatgtggcaagaagcccaagacacacaggatagaccatgtctgatgcagccaacagctccagctgagctccccccaacaaccctcaccaactgccaggcacgtgcatgagacaccttgagcaaccaccacagccaaaccttcagatgatcacagcccactccatatgtgtcagtaacatatgcagaaatccaagaaagaaccatccagccacgtctagtcagcccacaaaaccttgagagatgatactaaagcactgttttagtcattacgttagagaactatttgttacacagcagtagatgatcagaaccctgtaagatccagcataatgaacagttgttcagcttgtacacaccttaggcagcagctaggactagatgcttaataaatatattatttatggattagacaaagaatgtagtgtgtgaaaagattaaggtggaggctggatttatacccgtttatataactccaagttcctcctctcttttctttttaaccatagcctaatgctcccttaaaaacaataaaaccattttatttccagcctatcatatttgatgcaggtttgggaggaagaatacaatattcagacagagccatgtcacaacaaaatggcagctttggttgcttgtcatgcctggaaaaaagttcagagttaaaaaaaaaagtagcttgaggctgggtgtggtagcttacacctataatcctagcacttttggaggctaaggtgggtagactgcttgagcctaggagtttgagaccagcctgggcaatatggcaaaaccctgtctctacaaaaaatacaaaaataagccatccatggtggtgaatgcctgtagtcccagctagttgggagtctgaggtgggaggctcgcttgagacctggacattgaggctgcagagagccatgatggtaccactgcactccagcctgggtgacagagcaagatcctgtctcaaaaaataaataaataaataaaaaggctgttcttatgtcattacactcattgacagcacaggggtctctatgccctctctgcagttatagcatgagcgctgctgtaggcgatatctaaatgaatgggtatagctgtgttccaataaagctttatttacaaaaacaggcagtgggccagattcgcccaaccctagtacacagcataatacagtggtctttcaatttagcagtaagcacgcagtatagggaaaagttaatccacggacctctttttccttctgtaaattgaaagagagggagcctgcttcctttgatttgagtatggaatgaccttggctagttcgtgaagccatccatggtggtgaatgcctgtagtcccagctagtcgggagtctgaggtggaaggctcgcttgagacctggaggttgaggctgcagagagccaggatggtaccactgcgctccagcctgggcgacagagcaagatcctgtctcaaaaacaaaaacaaaaaaagatagactgctcttatgtcattacactcattgacatagctcaggggtctctatgccctctatgcagttatagcatgagctatagacaataggtaaatgaatgggcatagctgtgttccaataaagctttatttacaaaaacaggcagtgggccagattcgcccatccctggtacacagcataatacagtggcctttcaatttagcagtagccacgcagtttgtaaactcaatgaaacaggcaatgcctttgactgaaatgactcttggtactttaattttgcattttagacaacatctttcactgcattttcacatgctgaaatgggttcagatttctaaaatataagaaaaagttacagtaaaacaaaacaaaacaaaaaacacttaatatagggaaaagctaatccatggacctctttttccttctgtaaattgaaagagagggagcctgcttcctttgatttgagtatggaatgaccttggctagttcatgaaggcaggaacattccatgagacaggagttaggaaaccactgggtcactcatagcaaggataatttcccctcactggccctcaaagaactatttgttgataaataatgaatccaaaatctattggaaggagagtaatccactcattactgttagtccattcaatagggctcaatgactgggtgaagtttattcaaagcagcaaaatatcatctaatggcttgctcttttgtctttgtaggatcaagcctttcatcttagaaagtgctacccacgttatccaaaactagcaaaaataatttaattaatgtgtatataagccacaagtgcccaaattatagcttgtgcccaaaccctaggtaatgctagagttatacacataattttttaatttcgtattttcaagaaatgatagaccctataaattatatttttaaatgagccaggaagtaatggctaatgttaattcttaggcaacagaaacgtgctacgctaattattattagcaataatggctcaatgggtaaagaacttctgaactcacaaagcaatttttaaaaactgtattgcattgtttcatacctaaaagagtcccagggttaggtaatttttttcattttataggtgaataaagggagacgcagggtaggtacctgctcatagtcatagctaagtagccaggactcggttgctatccaaggcttcttctatctggaacacttcaagagaacaaggcaactcctctccaaatataattaatatgcaacctctcttcctattattctttgtgaagtttagcactatccaaaaaaatgtactaggctaattattcagatttttttttgcgaagggtgcaaatgttctttctattgaatgtgtgtgcatgtcatttattacaccatatttttaaagggagactaatgcccaataatgaccccagggcttagctttgaagaaaattccaaccaaaaacatcaccttactgtctgaatctgtctccatttcagcaactgaatctttgttgctggactcaataaaacacacttcagatttctaatgcttggatgggagatgagttggtccaagctagatcctcttgtctttgggcccacaccaaacaccaaacacgagtcaaccactcttgcaccaccacaggtatgcatgtattaatatcggcttcccttctgccacagctgtgacttgtgttgggattatttctactccgccagcttgtttaccttattagagtaaccttacagctcaatcattaggactccatggagaagccatggaaaatcaagactcagacatatatttcgatcttaggagaacatgcctgtgctttgtctgtcattattctttttatgggattctaaggcagtctaagataggagaatcactacaaggctcctgaaaaatccctgccaattaaggagtgacagactgcattttccaaagatgaccacagctatatttcctatcccatatgctcttctgcaaggtgactttgccacccccatcccttcaagaggtgggacttatttttcccgtccttagaatctggacaggccctgtgactgctttgagcaacagaatatggcaggagtgatgctgtgccagttttaagtgtagcccttaactttatggcagcttccaccttcctgcctgctggaggccagccaccacatcagaagtgacactaccctgaggccatccagctgtgagacaatcaagccacaggaagatgcttgatgctacctggagagaaacagacagaggggtcaaggaggaacaaagcaccagacagacggacgataaagtcttagaagtggatcctccagccccagtggacaacacatggagccgagacaaacctcccagcagagcccttcctaaggtcctgatccacaaaattaggaacaaaacaaaattaatgttttaagccactcagttttcagatagtttattatggaataccagagaactgttaacatttttttttcaagaccgagtctcactcaatcacccaggccagaatgcagtggtgcaatcttggctcactgcagccttgaactcctgggctgaagcaatgttcccacctaagccttccaagtagttaggtctacgtgtctggctagctttttttttgagacggagtcttgctttgtcacccaggctggagtgcaatggcatgatctccactcaccggaagctctgcctcccgggttcacgccattctcctgcctcagcctcccgagtagctgggactacagatgcccaccaccacacccggctaattttttgtatttttagtagagacggggtttcaccatgatgtctggctaactttttaatctttgtagaggtggggtctcgctctgtcacccaggctggaatgcagtaacatgatcatagatcactacagcctcaacctcctgggatcaagtcatcctcccaccttagcctcctgagtggctgcgactacaggtgtgtgccactatgcccagctaattttttaaaatttttcatagagatgaggttttactatgttgcccaagctggtctcaaacccctggactcaagtgatcctcccactttggtctctcaaagtgctaggattacaggtatgcaccactgtgcctggcccacaaattttactttattatttttttttggagacagagtcttactctgtcacccaggctggagtgcagtagtgcgatcttggctcactgcagcctccgcctcctgggttcaagcgattctcctgtcagcctcccaagtagctggcattaaaggcatgcaacaccacgcctaactaatttttgtatttttagtagagacggggtttcaccatgttggcaaggctggtctagaactcctgacctcctgacttcaggtgatccgcccacctcagcctcccaaagtactgggattacaggtgtgagtcaccatgcctggcctcacagatattttttattgaaacacaagttagatcttccttggggtcactgcaaatagttgtatgatttgtgtaccgcaaagtggcaaataggggctgaaatccaaccagtgctttgctcaccacgccctgcatcggtgagctctggtcttctgctaagaggctgacttttttagccctgcaaagtccccgtacagactagcagtacgtcgaagcacagtcatccaaatgtgggaccttcaataacgatgacttaagaatttgacggaacaatgtgattatcgttgccagaggaggtttttcttccctgctaatatcctggacacctcgctgggcttgccaactttatctggtcccttcttcctctgccccaagattccacccttaaactggagtaggtgctttcactgcccagtggggccgcccttctcggcaggcctccccagcagcgcctgatgtttcatctcatgtgaaattgccccaaaacacaggatcagctctgcactgggccatcactgccactcctcaggggcagctgagtctcctccctgtggccttccaacaatggctggcagtaaggctcattcagaacccattaaggcgattgttttttcctcaagggcacttccttgagggctgaataccaatcagcctgcgatacaaaggaggggccccctgtcatccttgggactgtgcagtggctctgtggggacaatcccacgtgctgtcctccctacaacctcactcccctgggcttttgtgcaggagtcaatattgattactgttatttctttcttttttctcttttttttttgagacagagtctcactctgtcaccaggctggagtgcattggtgcaatctcagtcttagctcactgcaacctctgcctcccaggttcaagcgattctcctgcttcagtctcctgagtggctgggactacaggtgcatgccaccatgcccagctaatttttgtatttttagtagagacggggttttaccatgttggccaggatggtctcgatcccttgacctggtgatctccctgcctcggcctcccaaaggattactgttatttcatgagatgactacaggctcatcatgccacagcagtggtgacccaggagcaattctcatagtataagcaagtcctatagcaaaatccatgggaacctataggaccgtggccaaagtcatctctgcctcccaagaaggggcaggaagtcctattggcctcatctaaccatttatgcctgttcttacaagctctcaatctgtccatccaacccaggagacactcggtcatcatccaccctttacttcttctgaaaagctgatgcaaataacttgggctttaaaacccaaaaagatctgtgtcccaatccagactctgccacttcttagctgtgtgatgttaagtgactgtctaaacttctctacttcctcacctgtcaaatgaaagcaaggacaccttctagcaaacctgagagaactgaacaagataaggccaagtaggctacaaatggcacccacaagttattccattcggttcatgaacaaacctttcattacaaattccaatacttatgtatttatgctgatgtatgagaagacgataggcttcatgaagaccatgattttatggacattatagcttaggttgagctaagtaaaaagtgagtggatgcaaagaaaaatatgaagtaaataaaccatgaccggggagtgttatgtggatgctgtagaaacaccaagaaaataagataggtggacacagccgggtgcggtggctcatgccgtgatcccagcactttgggaggccgaggcaggcggatcacgaggtcaggagttacagaccatcctggtcaacacggtgaaaccccgtctttactaaaaatacaaaaagtagctggctgtagtggtaggtgcctgtaatcccagctactcgggaggctgaggcaggagaattgcttgaacccgggaggcagaggttgcagtcagctgagattgcaccacggcactccagcctgggtgacagagcaagactccatctcaaaaaaaaaaaaaaaaaaaaaagatacgtggacacacaccccgacactgtaccacatggtaggtacagacatcaccaccacctggcacattttaggtgctgaatcagcatctgtttccctctcctgtaacctcctgtggcatcagcctccacccttgaacttggctccagcctcattagggtttggccaagccttagaagttggaggtggactccctgcagtcttggggacggttcccaacaccagggtggtaaggaggaatggtctttagctttgcaggtcatgatttcccttgaagcacctcgtaaacagcagggctggcccacctcaataaaattttactcagcgcttgcaattcccccaacttccttccgtagccagatgctgccctttgctgtgtgcttaactccccactgacaactgatggcatttagatgcattgtagggtgagacccagaaggctgctcattaacatcgtctatatattttaagagccaagaaaccatttttcttggacctaccaattatataggacaccatgcagctcccttccaaatgtcgacccactctagatagttgaggctaaatcaaccaagaaggtgtattagctttcaccagacccatggacaaataattcttcttacacttctaggtagcaatgtaacattttgcttcccagaaaccaaagctcacatttaaacacatggcacccaagcccatatttcaggaaaggccctttgttaattgttcataggaaagtaatccaatagggtctccaacttcctgctgctgttcattccacctgctgctacacctgggcttatttattccaccctgaatggttttctttcccccagcacacagccaggctggttcctgcctccgtgccttgcccaggctgttccctgagtcctgaatgcccttcctgctccttcctgcctaccaaataccttaaatacatccttcaaactcagctcagatggcgctccctccaagaagccacctgtaacttccagaaagttaatgtcccgccaccctgtgccacttcctacctcgtttagcacgtcatgtggtaccatgaccacttccatgtctatacgtgtattttgccacgagatctgttcccaatgttttgtaaggaacaaagtaagtgagcaatgcatgtctggagaatgaataaattcaggaatcccattaatgacagtatctatctgtttaacaaatattcatggagcacatactaagtgctagggactgaggataccacattaaagaagaagaaaggacagattcctgtcctcatggggtttatgttctagatacggggagaaaaagttacatacaaataaacaagattattttagatagtgataaatttatgacaacaataaaacaaggcaatagcattacggccgggcacggtggctcatacctgtaatcccaccactttgggaggccgaggcagatggatcacctgaggtcaggagttcaagaccagcctggccaacatggtgacaccctgactctactaaaaatacaaaaagtagccaggcgtggtggtccagctactcaggaggctgaggcatgagaactgcttgaacccgggaggcagaggttgcagtgagctgagatctcaccactgcactctagcctgggaaaaagtgtgagtgagactccatctcaaaaaataaataaataaacaaaacaaggcaatagcatagagcagagattagcaaactttgaccagtgagtcagatccagtctaccacctgtttctgtaaataaagttttattgacacatagacacgcccactaagttattgcctctgactgcttttgcccaacaatggcagagctgagtaggtttaacagagaccctatggcccataagcctacaatatttcctgtctggccctttacagaaaacattcacagacctctcatatgactaaggagagaggaaaaactttaagtagggtgaaaagggaaggccactgtaaaaagatgacatttgagtgaagaccagaatactaagaaggtgtcagccatgcaaaaatatagggtaaagcatcccagatagaagaaggaacaagtgcaagggccctgaggcaggatagagacagagaaaggagagtgtggcttgggagtaattaggtggtgaatgatacaaaatcaggcatcatggtaggcagagcccatgtgatggggaatctcacaagctgtggaaagggcttcctgctaacactcatgaataattctgaaaggcagcgaaggtatctgggatttgggcagcaagtggtgaaatcgtgtccacggaagagaagggacgatagcaccaccatcatgaatgaggaagtctaaaatgttgacgcttggctcaagacttctttgccaccacgaacaacatctccaagtcaagctctgccttttgttgttgtttggtttttctgagacagagtctggctctgccacctaggctggtgtgcagtggtgcgatctcgcctcacggcagcctcccaggcttaagcaatcttcccacctcagcctcctgagtagctgggactacaagtgtgcaccgccgcacctggctgatttcttattttttgtagagacagaccctcactgtgttctccttgctggtctcaaactcaagtgatcctcccatcttggcctcccaaagcgctgggattacaggcgtgaaccatcactcccagcttcaagttctgcttttcaaatgcgtcaccccacatccccaacacaaggttgcccaaatgtgcacagaagatgcttctacaacagctgaatcagcatccacatgtatcctacccacactcttttttgtatttaaaagactcactgtttcttctcttacattcgtgttttaaaaggaaccattagttcactttaaaatcacaggtttaataagccagctacatacatttcacttaaatacaaaaaggtttttttttttttaaaacgttcacctgtctaccacctcaaatcatctcagccacactctgggaaacaattgtttagagttcaaacctataggaacctcattaatttcaatccacacctaacttctgacagtactaccggagaggcgggggtttggaggacctttttattttttatttttttgagacagcgtctcactctgtcgcccaggctgaagtgcagtggtgtgatttcggctcactgcaacctctgcctcccaggttcaagcgattctcaccctcctgagtagctgggattacaggcacacaccatcacgcacagctagtttttgtatttttactagagccagaggttcgccatgttggccaggctggtcttgaactcctggcctcagatgatctgcccgcctcagcctcccaaagtgctgggattaaaggcatgagccactgcaccaggactggagtagcttttgaccaggacagtgaggacagaggacagcttgagggtgcagcacaagctctggcggcagagcttacacctgaccctgtcactttccagctgtgtgctcttgaccatgttaaatctgagagcctcagactcctgtctataaaatgagccaggctgaggggctgttgagagaattaagagatgcacctgacttggcccaggacctgacccatgctagatgctcaataaatggtcacagctctgattacaaatgcataattatttacagtcataatgatgatcatcaaaagtcctttggtctctccaaaagtgctaaaagcatctcttgtcatcaatgtgtctgagcttttgagacatctgtagccgcagcccactcaccaactgacatccccttgccgccaggggtttcgggaagctttcggccgtgtggtagttttccactgggttcaccaaactaggtctcttttttcttgctttccttttattttttgtttccaaaaggttcctgattaacaatctttcagagagggaggaggaaagaaattacagcaaatgttcctttactctggtccctgctgggctgggaggctgctatttcagactcaatcagctacctgcagggtcaatggatgaaatgcctccccatagggatcaggaggatgcagggccattgggaagcttccacagggacctgtggcctaaaaaccccaactgctcaaaagactcagggacctcaaacctaaaggggatgggagcccaatttctttaagaagcacccgtctttgaaaagcagcatttctcactctacctctgcagggggaaaggagcaacatacatcccctgaaagtaattaccttcaagttgtgaggatcaaacgccatccttaactggagataatccgaaattcactttgaaaccccctctgtccaagcaggcttaagtctctaactgcttaattcaagaaatcattaaaaatggtctttctttccttgccacaaacagagtaaggtaagagaaagacagccaagaaacctgttgaactgctgatgagaaatgcgacagcaataaaatcactggcccaaaataattctgccgcaggttaactcaacggcaagtatgttgctctcacctccaaggatggcgaattcttaagttcttttgttccaatcaccatcttccagaaatggctacattaagttgtagggcctcatgtcaaacaaaagtggcagcgaggatggttacttctgtgtgttaacttgattgggccacggggtgcccaaattaaacatgacttctgggtgcatctgtgaaggtgtttctggacgagattaacatttgaactggtgaactcagtaaagtacatggccctttccaatgtgggtggttatcagccagtagatggagggcccacaaagagggagagaaagaaatttatttttcttgcattactgcgtgagctgagacatccatctcaccttctccagctcagaccgggatttacattattggctcccttgattctcagacccttggcctgggactggatttcatgaccagctttcctgggtctccagcttgcagagagtagctgcagggacttcccaaactccataatcatgggagccaattcccataataattttttttttttttttttttttgagacagagtcttgctcggtcgcccaggctggagtgcagtggtgtgatcttggctcactgcaacctctgcctcccaggttcaagtgattctcctgcctcagccccccaagtagctgggattacaggtgcccaccaccgcgctcagctaatttttgtatttttagtagagactgggtttcaccatgttggccaggctggtcttgaactcctgacctcaagtgatctgcccacttcagcctcccaaagtgctgggattataatacacaggttgagcatccctaacccaatcatctgaaatgctccagaatctagaacgttttgagtaccaccatgatgctcaaatgaaacgctcactggaacattttggatttcagaatttcagattacgggtgctcaaccagtaagtataacacaaaatatcccaaatctgaaaagatccagaatgcacaaagattctggtcccaagcactttggttaagagacactcagcctgtacatggttctgtttccctggagaaccaaactaatacaggtgccttgttcaaaaattataaatttcaagatggcggcagcagaacattaaaccaagtgcaggcccattcctggaggggcccccagtcttgcctgcttccctttccagggtgcctctcatggctcctctccctgtattttcccaacctaaccagaccctatgatctgacaaaggaattctttttttccccaccctaatttgtgaatgtttacatatggtcttccagattcacaatccatgaacccccttgcttgcaaaaaataaaatgacataaaaacagagctaaccagccacctcagggatcctcaaaaccttttagtttgtagaccagaacctgaagcctgagcttcttttaattttcattatctcattctaagagatagtatctaaagtaaactggggctgaacagcactcataacttagctgaaaaaagaaatgtagaatgacccaaaatgtataataaatgcaaaatgagaaaagctaaacatgaaaaagctagtaatttaaaatatgtataagtaaataaaaataaaaccatctccagagcagaggtgggcaagcattttctgtaaagatccaggaatacacatttttggctctgcagcccataaagtctctgtggcagctactcagctctgcagtggaatgctgagtagccacaaaaaacaacacatacacgagtgggcgtggctgtgttccaataaagctttatttatataaacactgagctgactggatgtgtccttcaaggccttattttgctgacctatggcttagagcggcgcttctcaaacttcacgtgcacatctatcgcctgggaatcttgtgaaaatgcaaattctgactcagaaggtcgggagtggggcttgagattctgcattcctaacaagtccccaggggatgctgaggctgcgtgtccaaggaccccactttgagaagcaaaagagcacccccagaaaagaaaagaaggaaaacctactaaagaacccaaatttaagaagcacttagcagaacacagtatagaaaagtaatttattttctcatcaccaaggaacagagttatgcaatttaagtgtatcttcagaaggggaataccatgtcattggtgatcaaggatggagttaactatcattatcagaaagcaaaatgctacaccgtttttaaccaccgctgtgcattttctggtggcagttaacacggacatatagcgatcaatgcaggtaaacgaatccattcgaaggcaggccatggatggtaaatcacgttgtccaataaagttgctaaattagcaacagcgtgacacagagcattttttataaaagcgaatcctttttggaaggagatggactgcaggggtgtgtggctagcaagactggagggtggaagggagaagcagccatggctgcggatccttctggggtctggaagctctgaattttgctgggggatataatgtgaaaccggtgtggaggcttttcctgtgtgttatcaaggccccagtgagggtctgttgcccacaggcagataccaatggttgtatttcacacacagcggtatttaataaacctcttcaccatccagtttataagaagataaaaaaaaaatggctggttccactcaaacactgctggcaggaatgcagaatggcacagccactttggaagacacttcaacgatttcttaaaaagttaaatataaatttgccatgtgacccaggaatcctgctcccaggaatctacccaagagaaatgaaaacatatgtccacacccagacttctatgcaaatgctcatagcagcgttattcacaacagccccaaaagcagaaaaaacccagtgtccatcagccagtgaattagtaaataacatgccgtatatccttacagtggaatactattcagcaatatacgactacacatatagacctcaaaaacatcacgtgatagccagtgcaaaaaccacatactgcatgcttccatttatataaaatatccagaataggcagatctatagagacagcagattagcgggtgcctggaaatggactccgattggcataaggagtcttatcagggttatgaaaatgtcctaaaactagattatggtgttggttgcacagctcagtaagtttactaaaaattattgcatagaacccttgaaatgtgtaaattttacagtatgtaaatcacatctcaataaagttgtttaaaaaaatggttcccattatatctttccctttttcatcgctcacctctctagtccttaaataacatagagatcctgtagactgcaataaacccaaagacacgctggttgttctagaggaggctaaagcaagtcttccgacccaagcagatacgctggagatggcacatcaattgtcttgtcaaaagaggaaaaaaaaacacgcaagggccacgtatttgatttttacagtgaacgatgaattcatctgtggtcagagcatcactcgggcagagacgggcagtgccctcgaagatgcctccaaacccacagcctccaatcccaacccaatcccagcccaggagcttccaaagacctaagccctgaggagaatgggaatcaggagtgacggtaatgatgacaaaggctcagcccatcagctgtgttagaaaaaaaaaggaagagaaaacttgctaagtggagagccaaattcacctcgccccacatgcagccacgcccaaaactcccatgcccacccaacaagccatgtcttttgaaccatgctatcaccccgaaaagtgactcttttgaggtcacactctgatggcagaaaaaactcccatgtgcttggaaggaaatgaaaactctagtgatatacctttggcttgcctccagatggagaaagaaaatcttaagaaatgttgagctattgcaacatcccctttttgggaaaaacaatatttccagcagatgggagaatcataaaaagtaaggaagcacggtcgggaagggttgcctagaatgatccacagtgtctgcagtggccatcttcccccagcccacttcagaatccacaaacacgcatgatggtagcagccagctcagggtcaaagacagaacttggggctagaaactaggacttgggatggcccacaagtgggtccagccatgaccctggtcatctgggtgctgggtagttgagcctaccaggtacagaaggaaccccgccgaggaggctttggggtctgaagaatggaatttgggctccagcgagggacttaacagcatttcctctatagcctcaaaggtatttgaatcaggaacactagcttcacagccagaggcctgataatctccttctcccctttcattgaaaaagaaaatatctaagatactggagaatacagtaaaatccttaactctgttcccccacccccgcttttttttccttcattcctagcggcaaggctggataagcttatcaagagcaggcaaactacatcttagctctgatcctttcgagaaatccatttggcgcctttaacgtttcatttggcagattgaatttcgggcatgtatttatgggactgggtttgcccttaatagagtattgcataaatcccattacagtatccacttcagtgtgtttggggttttctaagccagggctttatctaagtggacagcatgggaatgacccactctggctcagaaactcccgcctctgccctggaaccaacctttgcagattgcctccatcatcatcaatgtcaaatgatgttttgggaaaagttctgggaagggtcagaatgaagcatgtcccatccacaaagaaggtggtgacaagcgtgtcatcacctgctagtaaattacaggatttccttccaggaaccacctcgctccacatccctcttccttctggcaacagccagagaaagtctgttatccacacaatgcctttctgtctttcgtaagtatgcaatgatgaagatgcattacttgtcatttctgaaaacaaaacaattattaagaaaagtgagctataaacaaaacagatcaggcttagcaaccctgaataagccagttctctgtaaccctcaagttaatcatttaaaaaaacaatggggccaggcacaatggctcatgcctgtaatcccaaaacttggggaggccaaggcagaaggatcacttgaggccaggagttcgagaccagcctgggtaacatagcaagaccccatttctacaaaaataatactgataattacaaaattagccaggtgtggtagcacacatctgtagccccagctacttgggaggctgatgtgggagggtctcttcagttcaggagttcagggctatagtgagctatgactgcaccactgcactctagcttgggcaacagagcgagaccctgtctctaagaaaaaaaaaaaaagaagaagaagaagaatggaattagcaatcccaacaacacaggtgtggagttttaatgcagatgaaagaagaaagcatgcttagctcacaggaggtgctcagtgacgcttggcccatgcactcatggcacacaccttagttcatctttcctagctggctctttcttggcagggctggacaggccacttacttcccaggcaacaaggcagagatgcctgtaagatgccttctgcgtacatggttcaggtccggcgtggcacgcaccatatgcaagagtcaggggttacaccaggctgaagtgtcagtacattaagaaccatttccttcctcctgggatctgtcctggaagcacgcacagaactctccattcactgacttttcacataaatagactccaaagcagaaatgcatggaaaggggctgacagcgggcctcagagccccacataaagctaaaggaaagccatttggccttctggaaccttcttttaccaaggcacactgtcccctcaccccctacaagaacccagcaatccattatctggtcactttcttctacgacacaagcaagtttttaaaaaaggcaacggcagctgcagtaaacgaagaagtgtacgtgatgagggccctttgggctatttcaggctctgtccctgcctgaaggtggctgtgggtttggttacatctaagttgggcctcagagcttgtgaaggtaaatgcttcctgatgagaaggaaaaaaaaaagtctaaggagtcttcattgattcaaccgacatctacaaagttcctactatgtgccaggctccagcaggtggccaaagggaacctggtatactaaagacctggtgccctctctccagggctgaatcctccaaggattctctcattgactttattttcatcttacatcacccgtgagcagctggggtagatgttgtgcagttactgaagaatttgtatgtactataggaggcatgaagaatgcatgactttatttacttccaactaaaggcaggaagtagtagtaatgtctccactgatatggtttggctgtgtccccacccaaatctcaccttgaattgtaataatccccacatgccaagggcggggccaggtggagataactgaatcatgggggccgtttcccccatcctgttctcatggtagggaataagtctcatgagatctgatggtttaataaatgggagttcccctgcacatgctctcttacctgccatcaagtaagacatgactttgctcctcgttcgccttctgccatgattgtgcggcctccccagccatgttagaacttcgagtcaattaaatctctttcctttataaattactcagtctcgggtatgtctttattagcagtgtgagaaaagacaattacacggtctaagagatgagcatgtcaaggcccagagagatgaagtgacttgcccaaggtcatacagacaggaaggggtaaagggatttgaaccaaggctgtctggctccagagtccccactcattgccatgatatcgccttgctttcaggagtttgctgtggtctgatctcagcactaccaccgtggctggcacatagtaggggcgtggatggcacatagtatgggcccaggcagcattggtgaaactgaatttgatcatcttatttaaagctactgcaatcacattcagcttttaagctacgggttgggaacgaggtcattctataaaaatggaaagcagaaatttaccctgaggaattttttagagttagggatagaagtccaaaagggaatctacttcaaatgaccagagagctaagacatgacctcaatacaatatgattaaatgagatgcagtggagaattacataacagttcagaaacacaatttacatctccactggtgctttcctttttattaaactagcatttctgttacgctgacaatacagaagagcaaggtcttctggaactgtttggcttacacaggcgtgagagaagtgaagacttattccattcactgggtaacatatgggtttcccagagagaaagtccacacagccatgcatgtgaaatgggtgatgataacaatagtaattgctgaccctcttgagtccttcctgggggccagacctgtgcgaaatgatccacctgcattagctcattgaatcctcatgagaaccttctgtggcaggtaaacagtatgggtcccattttacagatccgaaaactgagtgaagccgagctctaaactcaggccatctgtctgaggctctcagtccttagactacatttggaacactttactcaaagaacaccaattatgataaggaaaaaagaaaaaaaacgatgcttgccaaaatccagacatctcagacatgaaggcaagagatccggaaccatctgggcccgtgtagggtacaagctgccggcttcccactttaataccattcccttgggctaaactcccacatgtggccacagaaacccacttttcaaacccggcatcctccgcctccaatcgtatttggctccacagaagccaagaaggcatttggggacaagcaatctttatctgtaccaaatgtttattggagccactccaggaaatggtcccacgtgaagccaatgtgcacgatgtcacccacatctgcttggaatgcacttgtatctacattgcaatgctcagagttacatgtctcttgaaacgccaccctgcacagctatcacctggtccaacaagaataacagcctactgttcgtggagcggttgtttagataaagagaagagagggaaggaggaatcagatcgctccttcaaaatacctctccccatgcaccaattacagaaaattgttctgggaggcaggaggagctctccaaagtgtttaggaacacaaatctggcaagtttaaaaaatacagtgaagttcactttcctgaactccagcatcatgtcctcaaagctaaatcatactgagcagtatttgcagcaaagaggctgaatactggttgccgcacggtgcagtcagcctttctggacgggatcatacatacttaccaacagaattcttgaggtttgcagaggaaccaaaattacaaactatcagaagaagaaaaaccctcacatcaaatgcgaatggaacattcaggaagagagaaaggattaaagaaatggaaaagacgaaaacctttcccactgggtagaaggaaggagcactggtttccaaaaccactaaggggcccttaatggccagagagggagaatatttaaaaaggtctgcaattctagaatttccccacagatgagatcaggcatctgtgagacgaacctaatcgcagaggaaaacaggaagaagatgatgatgttaatagcgctctcccctaactttggtttggtggctgacccaacccatagcatttttatagccattatttcattcaatatggtaattgtgaaggtaagagatagcatgaatgaccactactcttgtacttcaccaaaaaagcctattgtatgggacactgatgtcctcattggggcaactatggccaaggtaaatgttaagtggaggccagattaaacatacgctacgtaagagtggaggactgtcagatacttgactatatgtaaggtagacactgatagcatgggtgcctgaatcagactaccagcgttcacatctgtatcagttcattcccgcatccctagaaagaacaacttgagactggataatttatgaagaaaagagatttaattgactcagttccacaggctgtacaggacgcatggctaggaggcttcagaagacttacaatcatggcagaaggtgaaggggaagcaagcatatggtggcaggagagagagagtgaagggggaggtgctacacacttcgaaaccatcagatctcatgagaactcactcattatcacgagaacagtaaggggaaagtccgcccccatgatccaatcacctcccaccaggcccctccctcaacactgggaattacaattcaacatgagatttgggtggggacacagagccaaaccatatcagcatccaagctcaacagctcacttactaggtgatcttgtatgagtcagtacacctccatgtctgttttctcatttataaattagatctgatcattgaaattaaagagttgtcataaggatgagtgcaatacagaaatattggtaaattctggtaaatacagaaatttaagctgttatcaaatcattgtcatcatcatagtggctaaaagttagtgaagcaatgatttagatcaagtatggcaggcacatggcatacgtggcacaatttcttcctcctgcatccatggtggacatggctagttgattgcagaactttgcctttaaactcagatgcagcctcagaattggtcacacagagttccagttatccccaaacaaagttgacggacagatgggtgaaagattttttgctaccctctagaacctcatcagaaaccagataaaaccagccgctcccagagaaacagtcacttcttgttggatagtggaaaagagcggctccctaaattacagtcatccttccaaagaccgacataattttgccatatctgcatgtattgtgtgctattatttatgcaatgtttatttgaatatatttaaaagagaaacttatacctgcatcccaaatgaaaaatgagttgacacaagccctaaacagaagataatgtgaaaagaaagaaaagaaaggaggaatggtactgttgtaatccggctagaaaacactgtagtagtaggttctgaatgtctgctttccattgttaaaaagggaaactgacaagttttagaaaggtgataaagatgtgctaacaacaaaccgagacttcctctttgactcaaccacttcctataagattcaatgtcatttaaattgtgccaaggtacctgtagtaggcagctcctaagatggccccaaggatacccactccagtatccccactcccacccaaatccatccggaatgtgagccagatttagtcactcacttctaataaacagaaaaaatacagaagtgatggtattccacattcaaggtttggttctaaaaagactgcagcgtattaggtgcatcttaggtgctgtctctcccatattctctcttagatccttggcttttggggaatccaactgtcatgttgtgagcttccctatggttaggacctgtaagaggcttccagctaacagccagcaaggaaggaactggggcccttggtgcaacagcccatgcaaaactgaggccagctaacaactacgtaagtgaatttggaagcaaatcctccccagtagaactttcagatgagaccaaagatctggccgtcaacatgaatgcagaatgaactgataaccttcataacattttctaattaacacatattcattgagaaagcaaagattcaagagatgcactgaaccagagcacgctgcttgctcacccatacaggcaaacaataagtggtaagtatcagaatgacttcctggatgagaattttcatgtacacatacacacataattacagtcagcacaactgcattcaatgtcagccatttctatcagctctttctcgttctttgatcttaattacatgaacaagtagcagaccatgagccttagaggcctgtggacctgagttccagtgccccctctgcccctaatgaactgtgtggccttgaaatagaaatggaatcttatccgttcatctgcagaatctggatactaagttccacttcacatgtcaatgaaaggaatagatgcatttgtatttgaatgtgattagcatggtttatggttgcctaaataaaatataagcttcctagtgtaatattctccatggactactgctctctgctacgatctataataacccaggctggagaagtccagtaggggtaagtttcacactttgggtcaggggagtcagcactgcatagaaatctaaagcaaaggtggctgaacgagaaaagctaagttccaacacttactaatggcgtggctgtgagcatggtaccgaccctcatctgtaaaacgggcataaccagtgcctacctatgttctgatggctgaatgagataatatagttaaggactcagagtagtgccaggcacacaataaaacaaacaaatgttacatattttgtcaaaattatcattaatttttttgagatgtattcttgctttgtcacccaggctggagtgcctcagctcatgcctccgcactccagcctgggcgacagaacgcctcccaggttcaagcgattctcctgcctcagcctctcgagtagctgggacgacaggaaaaattatcatttattgttattatcactatcataatttaattcataagtggttatatagagacctttatgataaatccagctcactgaaatgttttgtttggccacacagggtgttactgaaaaaaacacaaaactgaattagttgttaatatttattaaatattgcactaaaaaaaaggaaatttccggttgcttttaatacctgaaagaatggataaccctgggcctgattctcttacagtcacaggcagtggagccaagaagcaacagtccactgcctctgctcttctgtccaccaaagtcctcaccattccctatcgccctgcacctgtcctagagtaccaacttacttctcctggcctcaagggaattgggactttggactcttgttttaattccttaaagtcctgccttaaatttcaaattcttggatgatttttttaaatagcaggtactctaagtagcaatcgcaagaacagatcttgaataagattaagtctccctcaggaaatcctcagcaacactaagtgtcagataatggctgaggataaagataggatcattatcaaaaggaggataaagatccagctctctacaataaccctccacacgtgacccaaaaatgagcttccagagcttaaacgtcaaagcgttaaagttatttttgccatccccttctgtgatggttaatttaatgtatcaacttgatgtggccacagagtacccagatagtcagtcagacattcttctggggtgtctttgaggatatttctggttgagattaacatttgcactggtggctgatccacccccatgtatggtgagctcctctgcctggcttcttgagctgggaaacctgtcttttcctgcctttgagttcagatgaaaacattggcccttcccagatcttgagactgctggttttcagactggaacaacactctggccctcctgggacccagcttgccaccgcaggccttgggacttctcagccatcatacttgtatgagccaattccttataatgaaactgtatgcgtgtgtctcatatacatcccattggttgtttctctggagaaccctgactaaaaaagctgttatcaaattgatagtgcagagcttacaactcattgcagatcagaatcaaaagtgttaaagtgatttttgcccacctaccccccacctccatgatggttaattttaggtgtcaacttgactgggttatggggtgcccagatatttggtcattcttctggggtgtctgtgagggcggttctgaatgagattaacaccacatattgccccacatatttaagttgaggagcctcaactctctgcagacttatcactgccacaggctgcctggagcatttttagaccctggaggttccacagctctggattctcaatgagcccatggattcccccaccttgagagagggggcaaggaccaccccaggggatgctgggaagaactgcagagcatcctccaataagcctttgcagctctcttccctcttccccatctcctgagcccagctttctgcatcctcattcttttggaggaaagacaaaaacaagatcgccttattcctactcaaattagcaacttcatggcttaaccttcctccaaaactaaactgagagtggcaatataggggatttggattttcttcttcacatattcatctcctaaatgtttctcggtgaacgtgtgttactttaatcagcaaagatgatacaaattattgattcattctgcattcactctatgagaggcagagttagctcagcatttgaggactggacgcattggagcagaccgcttgggtgcaaatctcgactcaactctgtgacctcaggcaagggtcttaaatgcttttgtaaaataagtatgaaaattgtagttacctcacagggtggcagagattaaaagttaattgaagcaaaggaattggcatgtgcctgacaaatagtaaatgctcagtaagtacttgctacctatattatcatcattttatagtatgtatatatagtatgatataaaatataaacatacatgatatagtatctgatatggtttggctctgtgtccccacccaaatctcatctcgaactgtaatccccgtgtcgagggagggacctggtgggaagtgattggatcatgggagtgatttcccccatgctgttctcatgatagtgagcgagttctcacgagatctgatggtttaaaactgacagtttcccctgcattgtctctctctccagccaccatgtaagatgtgcctgccttcctctttgccttccaccatgattgtaagtttcctgaggcctctccagctatgcggaactgtgagtcaattaaacctcttttgtttataaattatccagcctcaggtggtacctttatagaagtgtgagaatggactaatacagcatatattaagttcctgctacatgacaggcattagaaacgtagtgatacaactaatcacctaaccccatgggtcttaacctatctagcaggagtgggacattatataaatacacacctctttctgttccaggatccaatccaaactgctttgcactttgtcatcatatctagactagagggttttctttttgaaagctcaaagctgatccttttcctgctttgagctcccaatacttttccatgacactctcaataaaatccaaactccttgctttggtctcaatctcaaagctccccatattttcacccactgacccctcttcctttcccccaccaggctcccctcactcaatgaccaccaggcacactggccgttcatcaactctttgaatcccaagcttcctccagccttcacattttctgtgcctcctggctggaaatctgtttcctcagaggtcctcataatgtttcctcttcatgtttaggtgtaagtgcgaatatcacctcctcaaggaggccttccctggtcatcccagccaaacaagtctcagcccaccatagtcaccgtctaatacacagtggtttttagaagaccactaattgctaaactaatcctatttatatgtttataatttacagtctaaccctcagtactggagtatagggaccttttctatcttgttcactactttttttgtctttttgagacaggttctcactctgtcacccaggttgcaatggtgatcacagctcactgtaacctcaaactcctgggcttcagtgatcttcctgcctcaacctcccaagaagttgggactacagacacatgccaccatgtccagctaacttcttcttcttttttttttttttaatagagacagagtctcactatgttgcccaggctggtctggaattcctggtctcaagtgatcctcccgccttggcctccaaagtgctgggactacaggcacaagacaccatgcccagctcaccattttattgtaggtgcctaggagagcatgctgcacatagtagatgctcaataaatatttgttaaaataaatactattggaaggaatgaatggatgaaggacaggcatatattttcaaatgttcacagatgtgtcgcaagaacctagtgcagtgcctggcacatagtaggtgctcaatgagtacttgtcaaaatacagactgagggaatgaatggataaagggcagacatgcactttcaaatgttcattgatgtgtccctagaacctagctatggcacctggagcatagtaggtgctcactaaatatttggtaaaataaaaatgggttagaagagtgaatggatgaagggaggacaccatttgtttttttagacagggtctcactctatcacccagactgaagtgcagtagcacgatctcagctcactacaacctttgcctccagggctcaaacaatcctctcacctcatcctcccaagtagctaggaccacaggcaccaacatgccaggctaattgtttgatttttggaaagacagggtttcactatgttacccaggctggtctcaaggagcctgagcttaagagatcttcctgcctcagcctcccaaagtgctgggattacaggcatcagccacacttgttcactgatacgtcccaagaacctagcccagtgcctggcacgtagaggctgctccataaatattaatatttgtcagatgaatggcatttgagtgagcaccatccattgttaaagaaagaggtgaccacatagagtgagtcggctggaggccactcttctgcccaagggcctctctcaagaagtcaccagaaaggaaggctgggagcccttcctggcagctgccagaacatctgtctagagaggccccgggctcacctgggctgcgtggaggcctgggctgggctcttttgagcgactctcactactggctcaggaagttccacccagtgccgccccagcatggaggctcctctgtggcctcaatgcaaactcgcctcagaaaaggcagctgattaacacgcgtggagggtctattgtctgaatcccgtcaccagcggagaaacagctgtttatagtttgtttattcctctccctttggagcccacgggaggaaacacaagcgcttgttctcaggggcaccattcagcagctgaagtgagtgaagaaaacggtgtttatttttaatgggataaagagggggaactcttacaaagtttggacactagcagggagaccgctcttcaggaggcaccaggccttgtggtgatgtgttgcaccctgcctctcgagggatgctcaagagtctattccaactcccagctggaaactcaggctcgggccacggtggtcggtcaaacagtagacttgggtgagcacctatagatatgagagatctagaaaagctcgtcaggcttgaaaatgagagagcaagatttctttggagagcaaccacctgctatttaatataggtgacatcctataaagggctgccaagcccagttgtgcaggctgggcactgcacaaaggtgtccagctgagggagaaatccagcctctgtgagctgctcatcaagccatgctccacagtttcaaaaataaatacatacataaataaagatgactaagtgagacaacagcagtctcacagatatatagatgtatttatgtacttcatctttaaatgctcacttattgactcttcacaataacctttcagattagggaccactgtcatcctcactttacagatggcacactgaggcagagagagggaacctgactgctccaagctcatccaattaggaaggagtgaatccaggattcaaacccaggctcttggtttccatcaacaggtgatgctgcctcttctaggaaaaaaaaatggctcaacaagccccagagtgtcatattcagaaaacacagtgcccctcccagtcttgggagtgagacctgctttcagaaacacccatgtcttccctcgattctgcaggtgatcaggctggaaggaggtaggcgaagaccccatcgtctgcattacaaggaactccttctaaagactcaaaagatttgctctgaactggtgaaagtctggggactcccactcagcctggagactcaaccaaccctcagcggggaacagcccaacccaaccagagctgaggccacccgctgctcccttctcagggcccagggtcagccaaggccattttcaagtgcgggggactgcagccaaactcgctgaaccagacccaggggagcccaagagggacctctggactcaagggaagaggacgctctcatccctgtctactctcccacccaccccctcctcccctccatccctccctccttcggagagcctccacattcgaatctccgaaaatggttttcacaactcagttagcagcaatcaattattcacgacctcgcttccccaccaactcatagactgtcactgttagcaagataatttctggactctgcccaacagccctgctctaaaccaagcggcctgctatttatttcctctcttccctaagaccctcccaatgcccaccaaccactatcactctcaacacaggacagagagacagatgggaagtcccctgggtgcctgtagcctgggagggacctgacagccaggggctgctcccagcccacgtgatacatttcaggcttggggcagaatgtctgaccttagtttaatccaactggaaaacaggactcaagcattctagaccctgtgccaggctctgggacaaatcccacattattttataaaacgctttaagctccgaaaacattgtgtcctgcacaaagcatgacttgggagggtctcccagacatgccgtcctgctgctgagttcatgggtcaaagacatttggaacttggcaggggctcatattttaagactaccactagcatttccatcctagaagcttgaagctgtctttaggaacatattcctacatcccagggagaaggagagaggtgcttatgggatgctcttggaaaaagagtttcagcctatgtcgtaagacccatggagggtggttggatagcagctctgctgtgtgaacaagcgaccttccacgaaagccacttttcaccctctaagcctcaatgtccacatttgtaaaatgggagaatatgagtactacttctggggctgcagtaagagttttaaaaaatgaggcatttaaaaaacacccagtaccttgcttggcacattgtggacattgtggcctctgtgcttcattgtaagaccctgtcgcttgtgacatgcatcattgattgaataacaatttggggcaaaagggtgtgtgctgaaacattaaggaaacatacacatcaattgtaaaattcatcccagatttcagaaaggctatttactaaatattaaaaatgtgtatctttggccagatgtggtggctcacacctgtaatcccaccactctgggaggccaaggcgggtggatcacttgaggtcaggagttcaagaccagcctggccaacatagtgaaaccccatctctactaaaaatacaaaaattagccaggcgtgatggcacatgcctaaaatcccagctacttgggaggctgaggcagaattgcttgaacccgggaggcggaggttgcagtgagccgagattgcgccactgcactccagcctgggcgcagacagagcaagactctgtctcaaaaataaaataaaataaaatggctgtgagcctgggcgacacagtaaaaaatgtgcatcttaaaatgaagcatattatcattattatcattattacaattgctgtattcattttaggtgggaaaatgcatacagagaagctatgtgactgaccgcaggccacacagccagcaacacaatctagtccccacacagctccagaggaaggagggagaggaagaggcagagttgaccaggcaaatctccctcatccaattcctcctcctcctacaagaatcaacagtaataataataatggaagatgagggtgaggggaggtggaggggggaggaggaagaggggggaggaggaagagggggaaggggaggagggtggaggaggaggagggcagaggaagaggaagaggaggaggaagcagcagcagcagcatgttatggtgcttaatacaggcccagacactgtgctaaatgaggtgcatgtattaactcatttatttctcctgacaaccctttgaagtgggttcatcatcatccccattttacagatgaaggagctgaggcacaaagacttcagtcacacagctgctgggtggcagagccaggctgcgaactccggcaccttggcgccaagtccccgtgcttctctactgcattgcacttcattccaccaactgagacaaagagggacgttttggtggagaaggaagtggcatataagtgtcatgccatgcctggtctcacccacacgcccaaggaagttcctctgaacccacagagcatgccctgggctccctctgatgaaagcaagttcatgcctctcttccactctctcctgctgccccaggccagctgagcaggccaaaggagggctggggccaaatctgcagccccatcctggggaaaggctctgacgacagtagccagcttctcactgctgtctgcaggatctcagcaattccacgggcatggagaacagcagcccctggagagggtaggagaagattgggtgtctgccaggcctgcagctgtggacacttcccctatgggctgcggggacggggcaggcccagcacctggaagagggcgcctcccctgtctggctggtcttcagtcccatcaacgggacttagcatcaagtgacgtggtggttatgcacacgggcttgtggggagctgtgcaaccttgcgagagttacttcccctctctgtgcctcacttcctctgtccataaaacagtgactctgacaatgctgacaacactaggtgttggaagcattaaatataaaacgcctaacatgtagtatgtgcttaataaatggtagctgctaattactattatttatcatcatcaacaggactatgcatcaactactaagaacacaggtggaccttaaggtgccatcagtatgggtgaggagctgacaagaacccatggaacaaggcatgattccttgttctagaatatctttggcctttggatcttaaaatgtcatcttaaagtggggttccatagctctcacttttaagacatctcatctgatctttcaggcaatttctgaaggaaacaaaaatatttactgagcacctattgtgtgccattcactgtttccaccactgggaataacctgatggagttaatgaatccaagaccagctatgatggtgatggcagttactaataaaaggtgagaaggaccgggagtggtggctcacacctgtaatccagcactttgggaggtggaggcaggcagatcacttgaggtcaggagttcaagaccagcctggccaacatggtgaaaccccacctctactaaaaatacaaaaattagccaggcatggtggcaggcgcctgtaatcccagctactcaggaggctgaggcaggagaatcgcttgaacccaggaggcagaggttgcagtgagctgagattgcgccactgcactccaatctgggcaacagagcgagactccgtctcaaaacaaacaaacaaacaaacaaacaaaaaaaaaaaggtgagaaggattctagagtttattgttaggtagaagtgggaggtactgggaggaaaggactcttttctgcagacaatcacaccaaaacagccacgtacacatggaagtgggaaaggacacgtgggtcacacacacggctggaagaagagacatgtgcaatcagggcacaggtaaccacaagagacctaaaagttcagagcacaagggacccagaatccctcagaccattttaaagacggggaaacagagaacctgaaaggcaggcagcccaaagccacaccaagcaagacacagaacaggttctggaatccaggtatcctgactcctgaaagtcgagatcactttgtcttgcgtcgtaaacagactaagacattccagcacagcacagcccgccatcacagacagacactgctgccaggtcaggcagcccccatctgccatctctctagatcagtgttaccaagctgaggggagtgtaagacaccaccaccctcaaaatcaaacaccttaggacaggaccaaagacaggtaagttttgacatggagatgagggagagaagttccgagttggggacatcatcattctgcaggggcaggtggggaatcgaaaaagccgttgcatgcaaaggacaaatgttctttcattggaggtggagtgataataactgcagagggactctgggaaggttgttggacagagtgatttttgtcttcaaagaacgtgatcaactttttgcaagtgttcaagttccacctccaaatcttgcaatttctaaaccagtcaacttttctaggtttttaataaaacagagatgatgaacccattagcagggctgttgggaacctcaccccagaaaacagttgatggtggcctggaagcccctgcaggctcttgttcctgtccttcttcccaaatgactttcatgtccttgtcataatgaccacattgtttacctcctctccccgcaatccatgccggactatcttctctttgtttcatcttaaatgtcaccttgttggaaaagccttcccagatgaccctccccttctccctgactcactgtcccctccatcggaacctgagctgcaggaagtcagggaacgcgttctgtccactgctccaaccccagctcccgtgcagtgactggcacctagtaggctcttggtaaaatctgttgagtgaatgaataagtgtctgcaaacatcctgggtacatctgtaaagcatgcactcatagaaaacttctactatgtgacacacagtagattatcaatggctgttgctgagaggacatcaaagtcaattccaaaccaacaaggtcggcttcccatttccgctgtggagtagccttgagcttagtgagatagaagactcttgcccatcaccccagggacctgctccccagagctcaaggcactcagtaatgaggaaaaccctggctttacaagacacagtaaggcatgaaaactggggagaaagttcactgggaacctgcaggacactacaggtattctacaaaatgataagctactctgccattcttaactattcttaaaaatgagaggaaattgatcagcagaaaaaaggtacatgaagtgtgctgtgttttgatgtgggcaggctaagtgataacttcccctaacccgcccatcctaataacatgaaaccagtggtgcctcctgctactgacaggttcccttactcaattgctataagagaagcattgagcaagcattgagaattaaggaacctacagcctattcatagattctaaccctaagaggaacgaaattagcactttgtatggttgggtcattaaaggatctcatgaattaatactatcgtgtttgcattctgttttgtgaatttctgcctttatttttcttaatgtccctttcctactttcttttgtttgattctcagtttttttctttttttttttttttttgttagtaacagggtctcaggcctggcaccatggctcacacctataatcccaaaactttgagaggccaaggcaggagggtggcttcagaccaaggagttcgagaccatcccagcctcaattatttttttaatggacttttattttaattattttactctttcatatttaatgtcaaaacctaaagtgcttttaaaatagactaccagttttcctctgggcacagttttaaccttatctcaagttttgatatgaagtattttcattttcgctaatcaatatataatctgaaatgtcaaatttaatctattcattgatctaagaattacttagaagagtttcgattgtttaaatttctatgcgattgtcttttagaggctaattttcaatatatcttattgttttatgaaggaagcctggaagttttctacttttgaaatctattaagattctttttagaccaagttaattatcagttgtaattagcacgttagaacatctagaaagtagtctttaaaaagagaagttcttcccctagaatacacacacacacacatacacacacacacctttgtaaagagtttcaatgaatacttacaattctagtcttaccttaacaaaagtaaatattccaacagaaaaagacaacctattaagctaaagggaaaggaggcaaactaccagaatttaagggttaagtttctcacatctgggaattccactctggaatcataaccacaatagcattgcagctttgcagccctattttaaagacgaaaactgaggcttccagatcctgagtcacatagaaaggattttagctgagcccaagggtttcaagtccacaaatcctttctgcactaaattcaaatttcattccaaaagtaatactaaaacagcagctgaccttcttctcttgtgccattccttaagtttgttcatcgcaccaggcagaatcagaagacaggctcctacaacagctagggctttactcctggtaaagtgggttggcttaggagaagaacggacaggactctttgacaagccccagaaagaatattaagtcatttttcagccagcaccaagcaaacctgaaagatgggtggatcctagggtatcctaattttactcttccaaccctgtcagtgctagtgtccaaaaagtggagcagcaaatgggaagtgactggcattcagaaactgacacaggatcctgcatttctaaacaatgctgacaacgcacactgaggcagcacctccggggaagtctccgtgctccgatgctgtggccatgtacagcatatgcagtccccaaagggatatttcagcacagagtttcaatgtaaaatgacacacgctactgcaggctagagatcttattggggacacagggctatattcatctgcttcccagcaagaaaaccagaaagccagagataaacagaagtcaatcaaagcagaaagtgacatctagaaaaaaaacacctaattctgccaaacctgttttgctgaataaagataagagcgctgtggacaatatggctttggtataagaaattaaatgatggcaccattcccaaaagcaactaaagcagttgacatcgggcttgttcccaacagcctagaagggactaagaatggaagaacaatggacaattaagaaactgtttctacggactctgaattttgcaagactaattatgaaaataagccttgttacagagtttcagcatttgaaagtattactgtgctttacttcctactctgaaaggtaagacttccaaattaaaatataattgtcaaatcaattggtaaaaaaaaagtagttaaattaattccgctcctaggtatatactcaacagaaatgtttgcatatgtttgccgaaagagatgtccaagaatgttcacagcagcactatttataatggccccaaactgggaacttcccaaatgcccataaacagaatggatatgtaaattgtggtatattccacaatgaaataatgcaaatgaacaattacaactctgtgaaccaatatagacatagggttagcaaactttttggtaacaggccagatagtaaatgttttaggcttagggcccatacagtctttgttgcaactactcaattgtgctgtcatagcacaaaagcggccatagctgatatataaatgaaatggacatggctgtgttccaataaagctttatttatgatcgcaattttttttttttttttgagatacagtgttactctgtcatccaggctgaagtacagtggcacaatcttggctcagtgcaatctctgcctcccgggttcaagtgattctcctgcctcagccacctgagtagctgggattacaggcatcaaccaccacacccagctatttttttgtaccttttagtagagatggggtttcaaccatgttggtcaggctggtagcaaacttctggccccaagtgacccacccacctcggccccacaaagtgctgggattacaggcatgagccaccatgcccagtcaatttgtggacacaaatttgaatttcatataattttcacgcgtcacaaaatatcattctttcctcccccccccgcccccccccgcaactatttaaaaacataaaatccatccttagctcacaggccatatgaaaacaggcaaaggaccagatttggcttgtaagctggggttcgccaaccctggacagagataaaactcccagacgcaatgttaaccaaaacaaaccaggcacaaaagagtacagactgtatgattccatttctaaaaagaggcaaaagtacctggtggggttagaagtcacgatagagaccctatccttgcaggcatggggtcagagtggacgtggccgggatcccgggggctggtgggctctgaattcgggtgctggttagttgggcgtgatccctttctggagctgtttattcatgatttctgcattctttctcatgcatgttctacttcaagagaagtttagcaagtttttataataaagtagcttacaattcaatcagcttcaaaaacagaagtataaagagaacgagagcaatcaaattaaattagttatgacttcttcatgatggccaggtacctgccaatgctagagtacttaagaatatttaataataatggctgggcacagcagctcacacctgtaatcccagcactctgggaggcctaggtgggcgaatcacttgaggtcagaagtccgagaccagcctaggcaacagtgagactccatctctaaataaataaataaataaataaataaataaataaataaataaaaggtagatttaaattgttttcctctattattgtgtttacttccagggtggagtttgtttcatggtttaagggatggtgctaccatcagaatccggccaggctattttctgcggcgtctgcgcataaagatgatgttcacccaattaccagcgactcctcgcatggaaatctaccatcaatactattaacataaacagcatctggcaaaatacatggccttcaacctacagcaaaacctgcgctggactctcacaaaggaaaaaggccaggtctggcttccatttgatttccagagaatacgcaattaattattttttctcaccgtcagcagctgagtctcagtgaaatccgtgcttgtaattatcgctgtaattattattttaatacaaatcagcaacttatcaaaatattacgtgtcaggtgctacctctctgctgcaagactatggatggaaggtggaggccgtcaccccagcttcactctgtgcacacagaggatgggaatcagggtgagggtacttctaccagagccagactttcagcttcctagatgtccacgtccacagtcagtttcacactcgaccttttttttacaggcaataagtcactctgtacattctatgtggtggtttgatcttgggcaattcagttcactcactgctaggtctcagtggtaccatctttgcagcaggcaaacagtacaaaccttttttttttttttttttttttggagacaggatcttgctcggtcacccaggctggagtgcagtggtgcgatcacggctcacagcagcctcaacctcccagggtcaagtgatcctcccacctcagcctcccaagtagctggaactacaggcatgctaccatgcccagctgattgattgttttatgtttttgtaaagacgaggtcccactatgttgcccaggctggtcttgaactcctgggctccagcgatcttcccacctaggcctcccaaagcgctgggattacaggcatgtgccaccacgcccggcaacagtaccaactttctggcagtgtccttctgaagaaaacctaatgggagttgttacatctttctgtgcggcacatgcatggcatttgacacacaggctcctgagtcacgctggctgagttgaaattccaagtcttctctgtgactgcaggtgatttcttaccctctctatgcctcaatttcctcatctgtagatgggaatactatcagcagccacatcataaggctgatataatgattaaaatgataatctaggagacgctgctcagtacagcacagtgcctgccacgtagtgacatctaatagataatagcaattattattattatcattctgaaagttgcaaactcaaaccccaacagccatcttgtgggtaacacagacaagtaaagtgacctggtgggcccgtgtacacgaggcagccacatcccccctcactcaaatggttacctctgggaatgaagaccagaatttcgaatttcttaataggcactctaaatttgatttggattggaaatcattgattttggctactaattcaagttttgatttttaaaatttaccttttctttaagaaaggaggaagaggaccctatgctgtcattattccatctggagcccacacctgactcacaaagctctaggtttccttctggcttacgtatttcccatcgctgctttctagcacccaccttcattggagggctgtatctgcctgctcactccaataaacagtcagtttcctccaaatgttgctgttgtgcgttttttgtttgctttaattctaaaagaaagccaaacagcagtcagcctccaggccaaagaagaatgaataacctaacttctacccatttctaaaccacccagtctttcactgaacatccttccttaggagacgtttagcttaacatctctccctgctttctgtctttaactcaccttctaaacaagagaaaatcagacgtcacaatttgaaaactatccctcaatagggttacaagaaaaagcaggcaataagagcattttacatccacaacagaatcatctgcaatacttgatgacaagcaaacggggttctcagtgtctttcataacagctgccccttttgagctaggataaaagaaagtgcaaaagagagacaatgaataggcttttatttcaaagagaacatctgcaaagcatagtcctccattaaaaaataaacagaaaacagccactagtctggggaaaaaaataagatttcccattacatctctaattaataaagccccatttcaaaaggaaaaaagaagaagaaaaaaaagaataactttttcacatccccaaagaaaggatgcttaatgaggtaactgttgtattacttgatccatctagtctggttttaatactatccttaaataatgtatacattagctttccattaccaaaaacatttgtttattttatgaacgtgagtctggttgagagctgagactctgcaaaattatcatgccgtccttgggctcccggcttttattgcttctcccctcgctcattatgaaatgattagttgtctccgatgcccttttgaattgctgctaacgttgtactgcggttctgttaccctggttctgaataggagagtcttggttcagggttaagttaatgtagtcattactggcccatttggggacccattcatcatgctaatttcatgtccaacacttgggggaatagagtacaaatactcaacgtgaagcaaatgcacagtgaatccaaaagacgcacatgaaatgtccagaactcagtcacagaagacaggcatggggagctctggggccattactttccataactgtgggagcaatgcagacatcagagagggcctccaatggggaattcctttccaagggacccagagcacagttcctcctaacatctaactttaatcctttccacttgaacttcagaacaaaacagcacagctgtttaccagaggagcaaagactcttcaaactggttaagttgacattgaccaaaccttggccatctcagcacttccttgatcgtcattaaccaaccaagctgcaatcaggatttgaaatccagttagagtttgcttatgtgttttcattttgttaacccacttcttcttacttaaatgccactttacctgcatgttaaacgagaagagtgttgaagctgccgttttgattggctggttatatttctgtattttccataatatacatttaaagaaatatacagcgattaataatttctttaaatattcacccaagaagaagagagtgcatctgggatgttgtcagtgctatgattcctggtctaggatactcggatgtgttcagtttgtgagaattcatcaagttgtatatttagagtaatgtttgtatcatatggttttgttgggaaaaaagcaactaaaagaacgcaggcaatatttaagaagtgagccagacgtggtggctcacgcctgtaatcccagcagtttgggaggctgaggtgggaggatcacttgatcccaggagttccagaccagcctgggcaacatagcaaaaccccacctcttcaaaaaatacaaaaattagccgggcatggtggcacgcacctgtagtcccacctactcagggggctgaggtgggaggactgcttgagcctgcgaggtcaaggttgcagtgagctgagatcaaaccactgcattctagccggggtgacgtaaggagtccctgtctcaataaattaacaaataaatttaagaagtgaataaatgttgtacagatacgaatagtaactttttataaagagtttttacagaatatctgcccttgtagcacctccaaccactggtgcatcacgattggtgtctataccatattttggattcctggggctcgtttaggactactatggcaaaaggcatgatccaaaataaatccttacccctgaataagtaaaataaatccacccatccaaaacaaatgcttatccacagctctttcttttcgttcagctccctaatggtttccttcgctgcatttgtaacaatctgattttttgcaatgttcttgtttgtttttattgggaggtcatcctgcccccaaaccataaagagcatgagggcagggtcacatctgtctttccccctgctgtgcataaggcctggcacacagcagaccccaaccagtatctgatgaatgaatggatgagtaggtgggaaatttccagtggatttcactcattcattctctccctgtcccccacgggttacaagacgctgtgaggaaggaacgcagacaaccccgtctgaacactcccacattgtgctgcttgaagacatgagccccgtcttccattcacatggggctttctgagcttcaaagcactttctcatctgtttatcaaatttaatcctcacaacccagggagggaggcaggcttattagcatcatctgatgaagtgccaaaaagacacagagatgaaagtcacggtccgtccctgacagcgctgggaccaagccaaggtgctcaggaatgttctacttttccacctcccccttgtctctaaagactcccaacttcccaatgcgtgttattgggggacaaggtcacgggaaacacagagtgaggggcagatgactcaaaggaggctgtcactcacactccctgcagaggggaaacaggtttatcaaattgcggaatgcatgattctatttctgtcggggacatttgccttcaggatggcctcatgcttataagaatttgcatattctgggtctccaccaccagctaggcggggagggagactccatcatgccagggcaaggcacaggcagtgagaggcaaataagtgcagtgaataagccacatgggaatagggtaaccacagatgctcatttttatgtcttcatagtgaacacggaggtcttccaaatgggctgcaaactcaacagccaagaggggccagccaggtgccacaggtgacaggagagatcttagggggactcttagggacccagtgggtctgcagtatcaccattcctcagcttggctgtttaacaccaagcaagcaccgtggaccctgtattgccggatcttatgacttttaaaagaattccaaaaatctacgctgtctcacggcatatcctaatctttaaattccagggcctatttattctaacacaccgtgtggacaaaatcaaacccacccacgggccatggatttgaaagtcctcctggctctagcaaacatctcctacgatgtggctgcatcaggtggcagagcagagcactgaccatgacccagagctgtgcctcaccatcaagccctgccaggtaggtgccatcatggcccctgtgcttcagacaaggagactgagctccagagaggcaaagtgccataccaccgatgatgtcagaccactgtcttcttcctcaacatcacacgacctgcctcccaggccccacagcatctgcccatctgctcccctggatcatttccagggttgtttcatgagctacaagaagaagagcttgggccccatgagcagagcagcccaggcctcatggacagttctgggatggcagagacctcagggctcccagggctctgaatcatactacttactccttgccctgaccttcccagaggacacctcccttgtgtgttcaagaggtcaccatgggaaagggtataggcaatgaaccaggctaggatgtgagagtgatctccctagagatcggccacttatcagcacgggctctaactcttgcctgctagactggtcctcctggagggcaggaggcacattggtcctgttcaccaaggtggttccagtgctggacacagggactggtaccttctaactgcaggagtggaggatgggtagataggtggatgaatggatcgatgggtaaatggatggacagatggatggatgaatggacagaggatggatgaatggacggatagatggatggatggatgcttagacaaatagatgaatggactgatggatggatggatggatggatgggtggacaaatgcatgcataaatagatggaggcagggggagaatgaggggctagagtcaacggacttactgactctgaactgggtagactgagaacacagcctttggagacaccacccaacttcaatttctagtttggacacttcacatctgcttaattttcatccaacttattgccttagttttcattatttcaatcagtaaaacagaaatgaaaataatagctcttaacttgccagatgttataagaattcaataaaagcatgtctttttagtccttccacagtgtttggtgcattcgataaatgcacctcatcatcaccatagttgcaatgtttgtgcctcctgggtagggaacatttgcatcaacctctctgccccacaaactcatcttaaactgaaaccacacatcttgtggccaaaaattatggcaaagcgtgccctgggaggagaaacaaatgcctcttaccacattacctcattagcatccactgacacattagcctggattagatgtccagataagcagtagtcacctggctgggacaaactaggcctgggacaggacaaatccattcattgcccctaggtggccctgaaagatgagacaccctcgtccacacacacaaagcttgagaatgggtcccaccccttcctcatctggcagggtgtctgggtttgcagttcctgacactaataatgccagtgtccaggttcagggctaaggtgacaccccaccccacacccatcttctttgtgatgcctctggcttccaatcgggaagggggcaaccgaacccagagagcacatgggcaccatctgatgagcatctgcgggcaaacgggtagtttctgttgcaggcggaaggaagtgtccgcaagatgatccgcactgcatgtttattgaggtaactctccagtgtgctgcagacccaggctctcaggtacaagtggcgggctcctcagtgggccaaccacagagcggtctgaaggaatggagcagcaggaagtctgttgtggttgaaagaaaggccattgtccccggccaaagaaccctgaacaatatcctcttgccccctcctccgcttctcccttggttagagagagctgaattcaagactcctctctctagccaatttcaacttccattcttgactgttgaaaatataatagtacacagcttgaaggattaaatgagttcatgcacaaagagggtttagaacagtgcctggcaaacagaatagagaacgcagaaataaacccacactttaatatcaactcatttttgacaaaggctggggaaaggaaagtcttcgataagtagtgctggaaaaacgggatagccattacctatggataaacttaagaatgaaactaggccccatcactcaccatacacaaaaaccaaatcaaaatagattaaagacttaaatctaagacccgagactatgagacgactagagaaaaaaacattggggagacacttcaggacgctgagcaagaattttttttgggtaagaccacaaaagcacaggcaacaaaagcaaaaatagacaaacgggatcacatcaagctacaaagcttctgcacggcaaacaatcaacaaattaaataatctacaaaatggaagaaaatatttgcaaactacccatctgacaagggattaataaccaaaatatataaagaactcaaacaactcaacagcaaaaaaacaagtagtccaattttttaaacaggcaaaagagctgaacagatatttctcaaaagaagacatacgaatggccaatggatatataaaaaaatgcacagcatcactaatcaccagggaactgtgagtcaaaagcacagtgagatatcatctcaccccacctgaaagggcttttatcaagaagacaaaaaataacagacgctggtgaggatgtgagaaaatggaacactcatacactgttggtgggaatgtaaattagtacagccactatggagaagagtatgaaggttcttcacaagctaaaaacagaactaccatatgatctggcaatcccactactgtgtctacacaggaaaggattaattatccaaaggaaaggaaatcaataaatccaagagctatctgcactcccatgcttactgcaacattcttcacaatagccaagatatgaaatcaagttaagtgcccatcggtggatgaatggataaagaaaatgtggtaaacacacacagtggaatattagccagctgttaaaaagtgaaatcctgtcatttgcagcaacatgaataaaccggaggccatcatactaactgaaataagccaggcacttagagacaaatatcacatgttctcactcctatgtaggagctaaaaaaagtagatgacaagaagatagagagtagataggtgattaggggagtagggaggaagatgttgattggaaggataaaaatccagttagatagaaggaataagctctagtgtttggtagtccagtagggtgattatcattaacaataatctattgtatatttcaaaatagctagaagacccgggcacagtggctcacatctataatcccagcactttgggaggccaaggcaggcagatcacctgaggccaggagtttaagaccagcctggccaacacggcaaaacctcatctctactaaaaatacaaacagaattagccaggtgtggtggcgggtgcctgtaatcccagctaatcaggaggctgaggcaggagaattgcttgaacctgagaggcggaggtagcagtgagtcaagattgtgccactgcactccaggccgggcaacagagcaaaactgtctcaaaaaaaaaaaaaaaaaaaggagctagaagagaagaatttcagtgtctctgacaaaaaagtaaagataaatgttggcggtaatgaatatcccaattactttaagttaatcattacacattatatgaacctatcaaaatatcacatgtaccccaaaatatgtcaaactattatatatccatttttaaaaccacctaacacatcataactgccatgcagtcattattattattattatcattattactacccttgtatttgcatcatgagttaggggtctgattcaatataaattgcatgtctgcttcttttctagggttggtaactttttaggaatctgcaacaagaagtgagaaaagtagaataaagatttttggggctgggcaaagtggctcaggcctgtagtcccagcattttgggaggccgaggcgggcggatcacgaggccaggagttcgagagcagcctggccaacatggtgaaaccctgtctctactaaaatacaaaaattagccaggcgtggtggtgcacgcctgtaatcccagctactcaggaggctgaggcacaagaattgcttgaacctaggaggcggaggttgcagtgagccgagatcacgccactgccctccagcctgggtgacagagcaagatgctgtctcaaaaaaaaaaaaaaaaaaaaaaaaaaaagatttttgggaatgcatggttgcatttagggtttttcaacaaaccatgcaaaaggaacgcaactcggaaaggtggcatctttggaaaggggcaggcctgggtttggatctcagttctgctactccccagctctgtgaacttcatgagcaagcagcttcacttctttgagcttcagtttcctcctggggacagcaaaagtcttatcccacaaagttgggagaaatcagtaagacagtaaggtaacatttacaaatccctccattattcctgccacataacaagccatcataagaccagcgatttctagttgggtgtccttagttttaactttttatcagttgtgtaataccgtcttccttcctggaaattttttgtgtttttttttggggggggggggggtgagcatttaataacctaacgtatgcaaaatacctaaatgacacctgacatacagcaggcactcaataaatgtcagtactccttcctctaccacattccgtcctgctcacacagaaacagctatattcattctactgccttggatttactcgcaccctacactgtacgggaaaatgaataactgcaagaaattccttattttcaaacataccaagaatttccttttaagaacagctcatttttgaacactgattaaggaacaggcccacatgagttcacatatattgctacatttcatcctcatacagccctatgaggtagctcagattcacagaggaccgaaattacagtgacttgcccaagattaggggcatgagaaagggccgagccaggaggtgaacccaggtatgtcaggcctgagggtactcaacagaggcctctttcattggtgccggggcctcgcacatacttgttgggacgttttctcctgttcccacaccccttccttagaatgcaggttttgttaagatcgagtttgttttttagttattttttattttccccaaggcattttctctttgtttctggtagatggggatctgggtccgcagaaatggggaaatgcaaaggaaaaggaaagagagagatcataagtggcagctcttaaggtagcactggtcaaaagatagagactctcaacctcacctgtgcagtccaacaggtgtgtgtgttaagttcttctgcactgaaacactcatatagatggatttatgaccttatggatcataaacagctctggagcggggtgtggggggcagactcttatgtcagagatatgcctaaggatatctttgctttctgaggatacacacacacatacacaatgacgcgatgatgtcaaatctctgctttaactcaagccaccaaatttcctcttctattaaaaccatgaatcaaacttgaacagtcaccagtaaataagaacttacgccatggctggcttcctaggtgaaaaatagcaagcctttgaccacccacccttctggaagatttttaaaaaatgaattgataaactgaagagaacgtctaaagtatgaaaagaccggaaggaaagtgaatacatagatatattagaattcatattacaaacatatctatacctacgtatattatttctacttttatttatctattttaacactttccatgataaacagatggcaacatttgcagtaagataaatattattcaatgatgcatatttctgtatacaaagtgtaatgcgtcgctcaaacaaaacaaaactccattgaaagtgtgaaaaaaaaaacgaaccatcaataacataccctgttttctgtggtctcagaacatctggataggaagaaaagctatacctccaaggctgttagaagcagaggtgatctaaagccagtgaaccgatctttcaaagtcactgctgatgtctaaaagagtcctgagttatctgagtaatgtgaagcatgaggaatttctgccgaaaaatcaacatttcaaaggcgtcggataatacagaaaccccattctactttgtgtgcttatgtagggcggcaggcggggggtgggaagggtaataaaaaattagatttcttaaatgaaacttactgagtaacagtttatctaagaacacgagcaataaatgtggggacttcaagaagagtcactaagggaaagaaaataaacattcattacattaacacacgcagctctctttcattttctccaaaatctattcagaacctgtaggctgatccttgtgacagttctcccaatatttttcctccctttataagggagtccatctgtttcttaaattctgagatgacagtaaaatccacagcttactggagacccagtgaaggaatcagtgtcagccacaaaacagctgcaatccacccaataattctaatatttaagagctttaaaagaggctgagaggaaaaggagagcttgcaaatcttttatggacatgccctctgactctgtctacttgagaaacggggtgtttcctcttggcttcttaagtgcaccaaaaatacaatcagggccttccaccgaagcgcagctccccaaacataaaaaggacaaatgctctgaggctgtgggcatcaggaaggaggaagatctggcttaggaaatgccctatacacaatgcctgcctgacactctctgcaacacacccaccagcaacccaggacacaggttccctctacatgcaagagccaaggctgtccacccaccccatccccacctgcaacagagcactgagctaaagcatcttcttctaagcatgtgtctaaccacctctctacaagagccatctggaaaatcacggggatttgtttctttaaatgtcccactcctgaatctccctccaaagcatcatcctggcagcctccgcagggtctggaaacaaactgcacatttcaacggcctctattgcttgcgaaaaggtctggtcctctccttgcctgcaacccaagctccagctataccagactttgggaacagcctgcccccttctggtctcctggagctccatggaagggcaggaactgggtgggcacagtcagagtaggacagaccccgggctccagccagcctgtctgtactgtgatttcaggatttagcaggtcatggagtaggtgtggggggagaggaaagaaaggagacaagcaaatgaaataaaatacaaagccccaagagacaacagtcaacagcatggtagacagccaccaagaagagaagagaaccaaaagaaaaaaaaaatacataaatgtccatcttggaaggtaaagaaattgagacattaggacatgcagatttggggagagtaactgaacttgcagttggaagcagagtttcagaaaagcaaagcacctccgctgctggaactgcaattccaaaaggaagtaaaaaggaaaatagtgtgttcccacctacctccccaaccgcagatctctcagaggctgagctgggtgtgagagagtaaaacactgagccgagcacacagagaggggctgggggtggatgctcacaatgccggggacctatgaagaaatcagctagccctgcctccttccttctcttcatttgtttcaacaggtgctacatgcatcctaaaggtacctcctgaacccactctgacccccagatgcaaatgatacagtaagccccaggcttcccccaccatgtctcccctacacgttcttacactggaccagcaggacacgacccacaaccctcccaccccacctcctgggctctggatgcacaaagaacttctaattgcatttctgcgggaacccatcactatcaactccaagagttcaaaggcagcgtttcagagtacccctctctgtaaagaagagatcgcaggacactaggaatgttctggttctccgtcaggcagctcacgccactattctccccgcaaatgagggaaagacttctccctgctacccacacagcaacgtgaaatgccatcacatcacgtcttgggactggctcagttctcaggcatgaagagctgcactccggcagaaagggtcgcacagactccgaagaagtttagcagctcagaaagcatcacgctgtgtactaaggcagtcttcagtgaggacttccaaagtgacaaatgatagaaatatgcattcagtcttcaggatcctgaaaccatccccctggtgtctaatatcctttaacggctaggcaaatccttgcagacaagtagtgtgatgaagaaacagacagacacacaacacattggctatgccctaaggcagaactcacgcccctggagaactgagaccttggctctgaaatggggactccggcctcctgccccatgtgctcctgctcctagctcagtaggctgggcaaggcagcccagagaaggtgggaaaggtatccctggagaagttagggacagggtaggaagacaagtcagttccccacccagccacccagatggccccagatctgcggaaaaaacagtttcagagccctgactgttcacacccacgaagggcaaagtaatcccataggagtggaagccctgacggtgtggtcggacacacagctggtgacctgaaccggccgcaacaagacagaaagacagagacaaccagctaggagaaggagccatgccctgaaactggagatggggaggagataaagtcacagagggcatgggagacggcaaggttagagacagagaaggtgaagacggaaggctcaaacatccagagaagagaaacagaagacccaaagtaagaccagacaccccggactgagtattgattcaggggcatggtcggggacttgggacgcccagctcagccctcatcgcaggccaggacgaacagagggctcaactgtctgcacccagctcggcaaaaaccagagagatgctgctgcgacaaccgcccaggaacagcggctgaggatccggggagatccactcactcaggcagggagcgagtcaccaagacctacacgcacggagcaagtcacctggggtccccagcaagagtgatggggaacaggaacccagccaggctccggtaacccccaaagcgcccccgctggagaaaacttcccccagaccccaaggggtccgtgctcagactctgaaaggggcagcccacgacccctgagccttggcagggaccccacccggcttcccggggcaagaggcgatgtggagtcggtaggcttgcagagtcccagtctgatgaccgagttcaagggctaggggggcgtggggtcgggctgccttcctccctccctcgccgcggggcgcgagccgaaagggcatcttaccagagcccgggcgggcagtgccccccggctggccggctgctgtccccgcggttctccggggccgcctccccgcgcccgcgcctggggcccccgtcctcctcctcctccgccgccgcctcctcctcctcctcgggctgcagccggctcggcgggcaggtcccggcgctcccggcgcggggccggggccgggggcggctgctccccgccgccgaccgctgcgcccccgcggcgctccccggccccggagtcgaggctgctgaaattccacacgaccagcgtctgcagcagcagcaccgtgagcgccgcgagcagcgccgagtgcgagcgccgggccagcctccgggcgcacggcgccgccaccatcttcggagcgcggccggcgagcgaggcgcggggaccccggcacgctccgggccgcccccgcgctccccgcagctcccgcggccgc
